(12) United States Patent
Knudsen

(10) Patent No.: US 10,570,457 B2
(45) Date of Patent: Feb. 25, 2020

(54) METHODS FOR PREDICTING DRUG RESPONSIVENESS

(71) Applicant: Medical Prognosis Institute A/S, Hørsholm (DK)

(72) Inventor: Steen Knudsen, Scottsdale, AZ (US)

(73) Assignee: Medical Prognosis Institute A/S, Hørsholm (DK)

( * ) Notice: Subject to any disclaimer, the term of this patent is extended or adjusted under 35 U.S.C. 154(b) by 0 days.

(21) Appl. No.: 15/509,798

(22) PCT Filed: Sep. 25, 2015

(86) PCT No.: PCT/IB2015/002055
§ 371 (c)(1),
(2) Date: Mar. 8, 2017

(87) PCT Pub. No.: WO2016/046640
PCT Pub. Date: Mar. 31, 2016

(65) Prior Publication Data
US 2017/0283884 A1 Oct. 5, 2017

Related U.S. Application Data

(60) Provisional application No. 62/056,295, filed on Sep. 26, 2014.

(51) Int. Cl.
| | | |
|---|---|---|
| C12Q 1/6886 | (2018.01) | |
| A61K 9/00 | (2006.01) | |
| A61K 31/15 | (2006.01) | |
| A61K 31/436 | (2006.01) | |
| A61K 31/4745 | (2006.01) | |
| A61K 31/513 | (2006.01) | |
| A61K 31/519 | (2006.01) | |
| A61K 31/555 | (2006.01) | |
| A61K 38/14 | (2006.01) | |

(52) U.S. Cl.
CPC .......... *C12Q 1/6886* (2013.01); *A61K 9/0019* (2013.01); *A61K 31/15* (2013.01); *A61K 31/436* (2013.01); *A61K 31/4745* (2013.01); *A61K 31/513* (2013.01); *A61K 31/519* (2013.01); *A61K 31/555* (2013.01); *A61K 38/14* (2013.01); *C12Q 2600/106* (2013.01); *C12Q 2600/118* (2013.01); *C12Q 2600/158* (2013.01)

(58) Field of Classification Search
None
See application file for complete search history.

(56) References Cited

U.S. PATENT DOCUMENTS

| | | | |
|---|---|---|---|
| 6,911,306 B1 | 6/2005 | Vertino | |
| 7,239,986 B2 | 7/2007 | Golub et al. | |
| 7,709,616 B2 | 5/2010 | Bentwich et al. | |
| 8,445,198 B2 | 5/2013 | Knudsen | |
| 9,598,734 B2 | 3/2017 | Knudsen | |
| 9,725,769 B1 | 8/2017 | Knudsen | |
| 2001/0051344 A1 | 12/2001 | Shalon et al. | |
| 2002/0164663 A1 | 11/2002 | Fuqua et al. | |
| 2003/0073083 A1 | 4/2003 | Tamayo et al. | |
| 2004/0018525 A1 | 1/2004 | Wirtz et al. | |
| 2004/0072722 A1 | 4/2004 | Kornblith et al. | |
| 2005/0176669 A1 | 8/2005 | Al-Murrani | |
| 2005/0260586 A1 | 11/2005 | Demuth et al. | |
| 2005/0260646 A1 | 11/2005 | Baker et al. | |
| 2006/0105360 A1 | 5/2006 | Croce et al. | |
| 2006/0121511 A1 | 6/2006 | Lee et al. | |
| 2007/0172844 A1* | 7/2007 | Lancaster | C12Q 1/6886 435/6.12 |
| 2008/0227663 A1* | 9/2008 | Tisone | B01J 19/0046 506/39 |
| 2008/0306006 A1 | 12/2008 | Croce et al. | |
| 2009/0023149 A1* | 1/2009 | Knudsen | C12Q 1/6886 435/6.14 |
| 2009/0221435 A1 | 9/2009 | Baskerville et al. | |
| 2009/0239223 A1 | 9/2009 | Gehrmann et al. | |
| 2010/0240043 A1 | 9/2010 | Rotter et al. | |
| 2011/0123990 A1 | 5/2011 | Baker et al. | |

(Continued)

FOREIGN PATENT DOCUMENTS

| | | |
|---|---|---|
| CA | 2428112 A1 | 11/2003 |
| CN | 102002490 A | 4/2011 |

(Continued)

OTHER PUBLICATIONS

NIH DailyMed for Fluorouracil (Sandoz Inc). Available via URL: <dailymed.nlm.nih.gov/dailymed/fda/fdaDrugXsl.cfm?setid=1911e06a-2f16-4b99-adfa-4b914d559e1e&type=display>, May 2010.*
Buhl et al., "A genetic response profile to predict efficacy of adjuvant 5-fu in colon cancer," Annals of Oncology 25(Supplement 4):iv167-iv209 (2014) (1 page).
Invitation to Pay Additional Fees for International Application No. PCT/IB2015/002055, dated Mar. 29, 2016 (12 pages).
Mizutani et al., "Significance of orotate phosphoribosyltransferase activity in renal cell carcinoma," J Urol. 171(2 Pt 1):605-10 (2004).
Okumura et al., "Correlation between chemosensitivity and mRNA expression level of 5-fluorouracil-related metabolic enzymes during liver metastasis of colorectal cancer," Oncol Rep. 15(4):875-82 (2006).

(Continued)

*Primary Examiner* — Carla J Myers
(74) *Attorney, Agent, or Firm* — Clark & Elbing LLP

(57) ABSTRACT

The present invention provides drug response predictors and biomarkers useful for assessing the responsiveness of a subject to treatment with one or more target drugs of interest, such as 5-fluorouracil (5-FU), irinotecan, and/or oxaliplatin. In particular, the invention provides methods useful in determining whether a subject is sensitive or resistant to a target drug by, e.g., measuring the expression level of one or more biomarkers of sensitivity and/or resistance to the drug in a biological sample obtained from the subject. The invention further features devices and kits for assessing target drug responsiveness in a subject, for example, by determining the expression level of such biomarkers.

15 Claims, 7 Drawing Sheets

Specification includes a Sequence Listing.

(56) References Cited

U.S. PATENT DOCUMENTS

| | | |
|---|---|---|
| 2012/0046186 A1 | 2/2012 | Pelham et al. |
| 2012/0214703 A1 | 8/2012 | Croce et al. |
| 2012/0302626 A1 | 11/2012 | Dave et al. |
| 2013/0053275 A1 | 2/2013 | Knudsen |
| 2013/0059015 A1 | 3/2013 | Lancaster et al. |
| 2014/0294730 A1 | 10/2014 | Slack-Davis et al. |
| 2015/0353928 A1 | 12/2015 | Weiner |
| 2016/0199399 A1 | 7/2016 | Knudsen |
| 2017/0283884 A1 | 10/2017 | Knudsen |
| 2018/0087113 A1 | 3/2018 | Knudsen |
| 2018/0202004 A1 | 7/2018 | Knudsen |

FOREIGN PATENT DOCUMENTS

| | | |
|---|---|---|
| EP | 1550731 A1 | 7/2005 |
| EP | 2081950 B1 | 7/2009 |
| JP | 2001-17171 A | 1/2001 |
| JP | 2002-531066 A | 9/2002 |
| JP | 2004-43446 A | 2/2004 |
| JP | 2005-530784 A | 10/2005 |
| RU | 2528247 C2 | 9/2014 |
| WO | WO-00/31930 A1 | 6/2000 |
| WO | WO-00/35473 A2 | 6/2000 |
| WO | WO-03/082078 A2 | 10/2003 |
| WO | WO-2005/005601 A2 | 1/2005 |
| WO | WO-2005/014856 A1 | 2/2005 |
| WO | WO-2005/047534 A2 | 5/2005 |
| WO | WO-2005/066371 A2 | 7/2005 |
| WO | WO-2005/087948 A2 | 9/2005 |
| WO | WO-2005/094863 A1 | 10/2005 |
| WO | WO-2005/100606 A2 | 10/2005 |
| WO | WO-2007/072225 A2 | 6/2007 |
| WO | WO-2008/073177 A2 | 6/2008 |
| WO | WO-2008/073629 A2 | 6/2008 |
| WO | WO-2008/112283 A2 | 9/2008 |
| WO | WO-2008/138578 A2 | 11/2008 |
| WO | WO-2009/036332 A1 | 3/2009 |
| WO | WO-2009/080437 A1 | 7/2009 |
| WO | WO-2011/032563 A1 | 3/2011 |
| WO | WO-2011/098578 A2 | 8/2011 |
| WO | WO-2011/135459 A2 | 11/2011 |
| WO | WO-2012/024543 A1 | 2/2012 |
| WO | WO-2012/106718 A2 | 8/2012 |
| WO | WO-2012/109233 A2 | 8/2012 |
| WO | WO-2012/163541 A1 | 12/2012 |
| WO | WO-2013/130465 A2 | 9/2013 |
| WO | WO-2014/195032 A1 | 12/2014 |

OTHER PUBLICATIONS

Ooyama et al., "Gene expression analysis using human cancer xenografts to identify novel predictive marker genes for the efficacy of 5-fluorouracil-based drugs," Cancer Sci. 97(6):510-22 (2006).
International Search Report for International Patent Application No. PCT/IB2015/002055, dated Jun. 10, 2016 (10 pages).
International Preliminary Report on Patentability and Written Opinion for International Patent Application No. PCT/IB2015/002055, dated Mar. 28, 2017 (14 pages).
Abba et al., "Gene expression signature of estrogen receptor alpha status in breast cancer," BMC Genomics. 6:37 (2005) (13 pages).
Affymetrix Expression Probeset Details for HG-U133_PLUS_2:209083_AT, <https://www.affymetrix.com/analysis/netaffx/fullrecord.affx?pk=HG-U133_PLUS_2:209083_AT>, retrieved Nov. 27, 2018 (4 pages).
Agrawal et al., "Long-term effect of fulvestrant on hormone receptors and proliferation marker in breast cancer," EJC Supplements. 8(3):111 (2010).
Arienti et al., "Activity of lipoplatin in tumor and in normal cells in vitro," Anti-Cancer Drugs. 19(10):983-990 (2008) (8 pages).
Baker, "The central role of receiver operating characteristic (ROC) curves in evaluating tests for the early detection of cancer," J Natl Cancer Inst. 95(7):511-5 (2003).
Bild et al., "Oncogenic pathway signatures in human cancers as a guide to targeted therapies," Nature. 439(7074):353-7 (2006).
Castelli et al., "In silico analysis of microRNAS targeting the HLA-G 3' untranslated region alleles and haplotypes," Hum Immunol. 70(12):1020-5 (2009).
Chow et al., "Increased expression of annexin I is associated with drug-resistance in nasopharyngeal carcinoma and other solid tumors," Proteomics Clin Appl. 3(6):654-62 (2009).
Dahlén et al., "Activation of the GLI oncogene through fusion with the beta-actin gene (ACTB) in a group of distinctive pericytic neoplasms: pericytoma with t(7;12)," Am J Pathol. 164(5):1645-53 (2004).
Di Lisio, "MicroRNA expression in B-cell lymphomas," Doctoral Thesis, Facultad de Ciencias, Departamento de Biologia Molecular, Universidad Autónoma de Madrid (2012) (223 pages).
Elstrom et al., "Response to second-line therapy defines the potential for cure in patients with recurrent diffuse large B-cell lymphoma: implications for the development of novel therapeutic strategies," Clin Lymphoma Myeloma Leuk. 10(3):192-6 (2010).
Etter et al., "The combination of chemotherapy and intraperitoneal MegaFas Ligand improves treatment of ovarian carcinoma," Gynecol Oncol. 107(1):14-21 (2007).
Fournier et al., "Gene expression signature in organized and growth-arrested mammary acini predicts good outcome in breast cancer," Cancer Res. 66(14):7095-7102 (2006).
Friis-Hansen et al., "Mir-449 inhibits growth of gastric cancer cells partly by inhibiting the expression of met and amphiregulin," Gastroenterology. 136(5):A-165 (2009) (1 page).
Fumagalli et al., "Oral vinorelbine and capecitabine plus bevacizumab in recurrent inflammatory breast cancer: gene profiling and response to treatment," Thirty-Third Annual CTRC-AACR San Antonio Breast Cancer Symposium, Dec. 8-12, San Antonio, TX. Cancer Res. 70(24 Suppl.): Abstract P6-12-06 (2010) (2 pages).
Gallardo et al., "miR-34a as a prognostic marker of relapse in surgically resected non-small-cell lung cancer," Carcinogenesis. 30(11):1903-9 (2009).
Genbank Accession No. AY889152.1. Retrieved on Mar. 5, 2013 (2 pages).
GenBank Accession No. HC040507.1: Sequence 486 from Patent EP2112235 (1 page).
Gerspach et al., "Therapeutic targeting of CD95 and the TRAIL death receptors," Recent Pat Anticancer Drug Discov. 6(3):294-310 (2011).
Grimm et al., "Drugs interfering with apoptosis in breast cancer," Curr Pharm Des. 17(3):272-83 (2011).
Juncker-Jensen et al., "Insulin-like growth factor binding protein 2 is a marker for antiestrogen resistant human breast cancer cell lines but is not a major growth regulator," Growth Horm IGF Res. 16(4):224-39 (2006).
Knudsen et al., "Development and validation of a gene expression score that predicts response to fulvestrant in breast cancer patients," PLoS One. 9(2):e87415 (2014) (12 pages).
Koeppel et al., "Irofulven cytotoxicity depends on transcription-coupled nucleotide excision repair and is correlated with XPG expression in solid tumor cells," Clin Cancer Res. 10(16):5604-13 (2004) (11 pages).
Kornmann et al., "Thymidylate synthase and dihydropyrimidine dehydrogenase mRNA expression levels: predictors for survival in colorectal cancer patients receiving adjuvant 5-fluorouracil," Clinical Cancer Res. 9(11):4116-24 (2003).
Kuter et al., "Dose-dependent change in biomarkers during neoadjuvant endocrine therapy with fulvestrant: results from NEWEST, a randomized Phase II study," Breast Cancer Res Treat. 133(1):237-46 (2012).
Lee et al., "Cancer pharmacogenomics: powerful tools in cancer chemotherapy and drug development," Oncologist. 10(2):104-11 (2005) (9 pages).
Li et al., "Intronic microRNA: discovery and biological implications," DNA Cell Biol. 26(4):195-207 (2007).
Li et al., "Selection of optimal oligonucleotide probes for microarrays using multiple criteria, global alignment and parameter estimation," Nucleic Acids Res. 33(19):6114-23 (2005).

(56) References Cited

OTHER PUBLICATIONS

Liang et al., "Caspase-mediated apoptosis and caspase-independent cell death induced by irofulven in prostate cancer cells," Mol Cancer Ther. 3(11):1385-96 (2004) (13 pages).
Liang et al., "Characterization of microRNA expression profiles in normal human tissues," BMC Genomics. 8(166):1-20 (2007).
Liu et al., "Roles of USF, Ikaros and Sp proteins in the transcriptional regulation of the human reduced folate carrier B promoter," Biochem J. 383(Pt 2):249-57 (2004).
López et al., Chapter 11: MicroRNAs in Lymphoma, *MicroRNAs in Cancer Translational Research*. W.C.S. Cho (ed.), 239-67 (2011).
McCune et al., "Prognosis of hormone-dependent breast cancers: implications of the presence of dysfunctional transcriptional networks activated by insulin via the immune transcription factor T-bet," Cancer Res. 70(2):685-96 (2010).
Medinger et al., "Gene-expression Profiling in Patients with Plasma Cell Myeloma Treated with Novel Agents," Cancer Genomics Proteomics.13(4):275-9 (2016).
Michels, "The promises and challenges of epigenetic epidemiology," Exp Gerontol. 45(4):297-301 (2010).
Nair et al., "A simple practice guide for dose conversion between animals and human," J Basic Clin Pharm. 7(2):27-31 (2016).
Narita et al., "Lower expression of activating transcription factors 3 and 4 correlates with shorter progression-free survival in multiple myeloma patients receiving bortezomib plus dexamethasone therapy," Blood Cancer J. 5:e373 (2015) (8 pages).
NCode™ Multi-Species miRNA Microarray Probe Set, Version 2.0 (Cat. # MIRMPS2-01 ), retrieved from <http://www.invitrogen.com/site/us/en/home/Products-and-Services/Applications/epigenetics-noncoding-rna-research/miRNA-Profiling-/miRNA-Probe-Set-Files.html> (2009) (21 pages).
Nielsen et al., "Design of oligonucleotides for microarrays and perspectives for design of multi-transcriptome arrays," Nucleic Acids Res. 31(13):3491-6 (2003).
Nikas et al., "Prognosis of treatment response (pathological complete response) in breast cancer," Biomark Insights. 7:59-70 (2012).
Ocio et al., "The Activation of Fas Receptor by APO010, a Recombinant Form of Fas Ligand, Induces In Vitro and In Vivo Antimyeloma Activity," Blood. 110(11):1515 (2007) (4 pages) (Abstract Only).
Paul et al., "Impact of miRNA deregulation on mRNA expression profiles in response to environmental toxicant, nonylphenol," Mol Cell Toxicol. 7:259-69 (2011).
Pradervand et al., "Concordance among digital gene expression, microarrays, and qPCR when measuring differential expression of microRNAs," Biotechniques. 48(3):219-222 (2010).
Reid et al., "Circulating microRNAs: Association with disease and potential use as biomarkers," Crit Rev Oncol Hematol. 80(2):193-208 (2011).
Rouillard et al., "OligoArray 2.0: design of oligonucleotide probes for DNA microarrays using a thermodynamic approach," Nucleic Acids Res. 31(12):3057-62 (2003).
Senzer et al., "Irofulven demonstrates clinical activity against metastatic hormone-refractory prostate cancer in a phase 2 single-agent trial," Am J Clin Oncol. 28(1):36-42 (2005).
Sezaki et al., "Over-expression of the dominant-negative isoform of Ikaros confers resistance to dexamethasone-induced and anti-IgM-induced apoptosis," Br J Haematol. 121(1):165-9 (2003) (Abstract only).
Slonim, "From patterns to pathways: gene expression data analysis comes of age," Nat Genet. 32 Suppl:502-8 (2002).
Suresh et al., "Resistance/response molecular signature for oral tongue squamous cell carcinoma," Dis Markers. 32(1):51-64 (2012).
The Japanese Journal of Urology, 94(2):159 (APP-105) (2003).
Van't Veer et al., "Gene expression profiling predicts clinical outcome of breast cancer," Nature. 415(6871):530-6 (2002).
Vangsted et al., "APO010 sensitivity in relapsed multiple myeloma patients," Annals of Oncol. 27(Supplement 6): vi15-vi42 (2016) (2 pages) (Abstract only).
Verbrugge et al., "Combining radiotherapy with APO010 in cancer treatment," Clin Cancer Res. 15(6):2031-8 (2009) (9 pages).
Wang et al., "Independent Validation of a Model Using Cell Line Chemosensitivity to Predict Response to Therapy," J Natl Cancer Inst. 105(17): 1284-91 (2013).
Woynarowska et al., "Changes in prostate-specific antigen (PSA) level correlate with growth inhibition of prostate cancer cells treated in vitro with a novel anticancer drug, irofulven," Invest New Drugs. 19(4):283-91 (2001).
Xu et al., "[Association of miRNAs expression profiles with prognosis and relapse in childhood acute lymphoblastic leukemia]," Zhonghua Xue Ye Xue Za Zhi. 32(3):178-81 (Abstract only) (2011).
Yang et al., "The role of microRNA in human lung squamous cell carcinoma," Cancer Genet Cytogenet. 200(2):127-33 (2010).
Yin, "Screening of laryngeal carcinoma multidrug resistance-associated genes and study on reversion by Chinese herbs," China Doctoral Dissertations Full-text Database, Division of Medical and Hygiene Technology. 8:E072-85 (2010) (3 pages) (Abstract only).
Zhang et al., "MicroRNA-650 targets ING4 to promote gastric cancer tumorigenicity," Biochem Biophys Res Commun. 395(2):275-280 (2010).
Communication pursuant to Article 164(2)(b) and Article 94(3) EPC for European Application No. 15820250.7, dated Jun. 6, 2019 (17 pages).

\* cited by examiner

METHODS FOR PREDICTING DRUG RESPONSIVENESS

FIELD OF THE INVENTION

The invention features methods, devices, and kits for assessing cancer patient responsiveness to chemotherapy drugs.

BACKGROUND

Gene expression analysis can reveal the presence of a disease, such as cancer, in a patient, its type, stage, and origin, and whether genetic mutations are involved. Gene expression analysis can also be used to predict the efficacy of a therapy. For example, the National Cancer Institute (NCI) has tested compounds, including chemotherapy agents, for their effect in limiting the growth of 60 human cancer cell lines. NCI has also measured gene expression in those 60 cancer cell lines using DNA microarrays. Various studies have explored the relationship between gene expression and compound effect using the NCI datasets.

The antimetabolite 5-flourouracil (5-FU) is the standard of care in systemic treatment of primary and metastatic colorectal cancer, with further activity in a wide range of solid tumors, including other gastrointestinal malignancies, breast cancer, head and neck cancers, and ovarian carcinomas. It is manufactured not only as 5-FU, but also as an oral agent, capecitabine, and as a prodrug, tegafur (DeVita et al., *DeVita, Hellmann, and Rosenberg's Cancer: Principles and Practice of Oncology*, 8th ed., Philadelphia, Lippincott Williams and Wilkins, 2005). 5-FU treatment results in a survival benefit in the adjuvant setting of colorectal cancer (Rougier et al., *Ann Oncol.* 1993; 4 Suppl 2:21-8). Response rates for 5-FU monotherapy in metastatic colorectal cancer are low (10-15%) (Longley et al., *Nat. Rev. Cancer* 3: 330-338, 2003), therefore it is currently combined with either topoisomerase-1 inhibitor irinotecan as FOLFIRI regimen or platinum-based oxaliplatin as a FOLFOX regimen and targeted EGFR-inhibitor cetuximab according to KRAS-status. Many rivaling factors at the level of both tumor cell characteristics and patient variability may impact the efficacy of 5-FU (Longley et al., supra). After three decades of examining potential predictive biomarkers, the results are mostly far from any clinical realization.

Adjuvant treatment of stage II to III colorectal cancer patients has stagnated, even with many attempts at introducing new drugs in the past decade (Venook et al., *Am. Soc. Clin. Oncol.* 83-89, 2014). Biomarkers to assist physicians with respect to prognosis, prediction of treatment efficacy, and expected severe toxicities to antineoplastic treatment of colon cancer are and have long been eagerly awaited. Although research on prognostic biomarkers in colon cancer began as early as 1981, few prognostic biomarkers have been implemented clinically except for carcinoembryonic antigen (CEA) (Ichiki et al., *Oncology* 38: 27-30, 1981) and microsatellite instability (MSI) (Reimers et al., supra), even though many have been examined (Roth et al., *Natl. Cancer Inst.* 104: 1635-1646, 2012; Bezulier et al., *J. Clin. Pharm. Ther.* 28: 403-408, 2003; Watanabe et al., *N. Engl. J. Med.* 344: 1196-1206, 2001; Allegra et al., *J. Clin. Oncol.* 20: 1735-1743, 2002).

Furthermore, during chemotherapy for cancers, critical time is often lost due to a trial and error approach to finding an effective therapy. In addition, cancer cells often develop resistance to a previously effective therapy. In such situations, patient outcome would be greatly improved by early detection of such resistance. Thus, there is a need in the art for proven methods, kits, and devices that can be used to predict the sensitivity or resistance of cancer patients to treatment with chemotherapeutic drugs.

SUMMARY OF THE INVENTION

The invention enables the assessment of responsiveness of a subject to treatment with a target drug of interest, e.g., by determining the expression level of one or more biomarkers of sensitivity or resistance to the drug, such as the biomarkers disclosed herein. Exemplary target drugs for which a subject's responsiveness can be assessed by the methods of the present invention include 5-fluorouracil (5-FU), capecitabine, tegafur, irinotecan, oxaliplatin, and derivatives, analogs, and prodrugs thereof.

In a first aspect, the invention features a method of assessing the responsiveness of a subject to treatment with 5-fluorouracil (5-FU) by:

(a) determining a level of expression of one or more biomarkers of resistance selected from, e.g., the biomarkers of Table 2 in one or more biological samples obtained from the subject; or (b) determining a level of expression of one or more biomarkers of sensitivity selected from, e.g., the biomarkers of Table 1 in one or more biological samples obtained from the subject;

in which the levels of expression of the biomarker of resistance or the biomarker of sensitivity indicates whether the subject is responsive to the treatment.

In some embodiments, the method further includes, prior to the determining of (a) or (b), providing the one or more biological samples obtained from the subject.

In certain embodiments, the method includes:

(a) determining a level of expression of one or more biomarkers of sensitivity selected from, e.g., the biomarkers of Table 1 in one or more biological samples obtained from the subject; and (b) determining a level of expression of one or more biomarkers of resistance selected from, e.g., the biomarkers of Table 2 in one or more biological samples obtained from the subject.

In particular embodiments, the difference between the levels of expression of the one or more biomarkers of sensitivity and the one or more biomarkers of resistance indicates whether the subject is responsive to the treatment.

In some embodiments, the method further includes: (c) if the levels of expression of the one or more biomarkers of sensitivity or the one or more biomarkers of resistance indicate that the subject is responsive to 5-FU, administering an effective amount of the 5-FU to the subject.

In a second aspect, the invention features a method of treating a subject by:

(a) determining a level of expression of one or more biomarkers of resistance selected from, e.g., the biomarkers of Table 2 in one or more biological samples obtained from the subject; or (b) determining a level of expression of one or more biomarkers of sensitivity selected from, e.g., the biomarkers of Table 1 in one or more biological samples obtained from the subject; and (c) if the levels of expression of the one or more biomarkers of sensitivity or the one or more biomarkers of resistance indicate that the subject is responsive to 5-FU (e.g., according to the methods of the invention), administering an effective amount of 5-FU to the subject.

In some embodiments, the method includes:

(a) determining a level of expression of one or more biomarkers of sensitivity selected from, e.g., the biomarkers of Table 1 in one or more biological samples obtained from the subject; and (b) determining a level of expression of one or more biomarkers of resistance selected from, e.g., the biomarkers of Table 2 in one or more biological samples obtained from the subject.

In a third aspect, the invention features a method of treating a subject, the subject having previously been determined to be responsive to treatment with 5-FU by:

(a) determining a level of expression of one or more biomarkers of sensitivity selected from, e.g., the biomarkers of Table 1 in one or more biological samples obtained from the subject; or (b) determining a level of expression of one or more biomarkers of resistance selected from, e.g., the biomarkers of Table 2 in one or more biological samples obtained from the subject;

in which the levels of expression of the biomarker of sensitivity or the biomarker of resistance indicates whether the subject is responsive to the treatment;

the method including administering an effective amount of 5-FU to the subject.

In some embodiments of any of the above aspects, the method further includes administering one or more additional therapies to the subject.

In some embodiments, the one or more additional therapies is administered concurrently with the administration of 5-FU. In other embodiments, the one or more additional therapies is administered separately from the administration of 5-FU. In certain embodiments, the one or more additional therapies is administered prior to the administration of 5-FU. In alternate embodiments, the one or more additional therapies is administered after the administration of 5-FU. In particular embodiments, the one or more additional therapies is administered within 1 week of the administration of 5-FU (e.g., within about 15 minutes, 30 minutes, 1 hour, 2 hours, 3 hours, 4 hours, 5 hours, 6 hours, 8 hours, 10 hours, 12 hours, 24 hours, 36 hours, 2 days, 3 days, 4 days, 5 days, 6 days, or 1 week of the administration of 5-FU).

In some embodiments, the one or more additional therapies includes one or more additional therapeutic agents, surgery, or radiation therapy. In certain embodiments, the one or more additional therapies includes one or more additional therapeutic agents. In particular embodiments, the 5-FU is administered alone or in admixture with the one or more additional therapeutic agents.

In some embodiments, the one or more additional therapeutic agents is selected from the group consisting of: irinotecan, oxaliplatin, cetuximab, leucovorin, SN-38, everolimus, temsirolimus, bleomycin, lomustine, depsipeptide, carboplatin, bortezomib, erlotinib, gemcitabine, mitoxantrone, cisplatin, busulfan, epirubicin, arsenic trioxide, bendamustine, vincristine, fulvestrant, teniposide, adriamycin, decitabine, estramustine, other chemotherapeutic agents known in the art, and combinations thereof. In certain embodiments, the one or more additional therapeutic agents includes everolimus, temsirolimus, bleomycin, or lomustine. In particular embodiments, the one or more therapeutic agents includes leucovorin and at least one of irinotecan or oxaliplatin.

In some embodiments, the one or more additional therapeutic agents is administered to the subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin. In various embodiments, the one or more additional therapeutic agents is administered in dosage form.

In some embodiments, the 5-FU is administered to the subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin. In certain embodiments, the 5-FU is administered to the subject intravenously.

In some embodiments, the method further includes one or more additional administrations of an effective amount of 5-FU to the subject. In certain embodiments, the 5-FU is administered to the subject once daily. In particular embodiments, the 5-FU is administered to the subject once daily for up to four days. In specific embodiments, the administration of 5-FU is repeated 30 days after the completion of the previous administration. In certain embodiments, the administration of 5-FU is repeated for at least 12 to 60 months (e.g., at least 12 months, 13 months, 14 months, 15 months, 16 months, 17 months, 18 months, 19 months, 20 months, 24 months, 25 months, 30 months, 36 months, 40 months, 48 months, 50 months, or 60 months).

In various embodiments, the 5-FU is administered in dosage form. In certain embodiments, the 5-FU is administered in daily doses of up to 800 mg (e.g., about 50 mg, 100 mg, 150 mg, 200 mg, 250 mg, 300 mg, 400 mg, 500 mg, 600 mg, 700 mg, or 800 mg).

In some embodiments, the determining step (a) or (b) occurs prior to the administration. In alternate embodiments, the determining step (a) or (b) occurs concurrent with the administration. In certain embodiments, the determining step (a) or (b) occurs after the administration. In various embodiments, the determining step (a) or (b) occurs multiple times.

In some embodiments, the administration occurs multiple times. In certain embodiments, each of the determining step (a) or (b) occurs prior to each of the administrations. In other embodiments, each of the determining step (a) or (b) occurs concurrent with each of the administrations. In specific embodiments, each of the determining step (a) or (b) occurs after each of the administrations.

In some embodiments of any of the above aspects, the biomarker of resistance is NT5E. In certain embodiments, the expression level of the NT5E indicates the resistance of the subject to the treatment.

In some embodiments of any of the above aspects, one or more of the biomarkers of resistance is selected from the group consisting of: NT5E, CNN3, ACTN1, FLNA, ATP2B4, CYR61, LGALS1, RHOC, RAB32, and TMEM158; and/or one or more of the biomarkers of sensitivity is selected from the group consisting of: APRT, GSR, TUFM, MRPS2, MTHFD2, WDR59, ANP32B, PMM2, STOML2, and NDUFAB1.

In some embodiments of any of the above aspects, one or more of the biomarkers of resistance is selected from the group consisting of: NT5E, CNN3, ACTN1, FLNA, and ATP2B4; and/or one or more of the biomarkers of sensitivity is selected from the group consisting of: APRT, GSR, TUFM, MRPS2, and MTHFD2.

In certain embodiments, the difference between the expression levels of the one or more biomarkers of sensitivity and the one or more biomarkers of resistance indicates the sensitivity of the subject to the treatment. In various embodiments, the expression levels of the one or more biomarkers of sensitivity in the subject having a statistically significant difference from the expression levels of the one or more biomarkers of sensitivity in a control indicates the sensitivity of the subject to the treatment. In particular embodiments, the expression levels of the one or more biomarkers of resistance in the subject having a statistically significant difference from the expression levels of the one or more biomarkers of resistance in a control indicates the resistance of the subject to the treatment. In specific embodiments, the expression level in the subject is significantly higher than in the control. In alternate embodiments, the expression level in the subject is significantly lower than in the control.

In a fourth aspect, the invention features a method of assessing the responsiveness of a subject to treatment with irinotecan by:

(a) determining a level of expression of one or more biomarkers of sensitivity selected from, e.g., the biomarkers of Table 3 in one or more biological samples obtained from the subject; or (b) determining a level of expression of one or more biomarkers of resistance selected from, e.g., the biomarkers of Table 4 in one or more biological samples obtained from the subject;

in which the levels of expression of the biomarker of sensitivity or the biomarker of resistance indicates whether the subject is responsive to the treatment.

In some embodiments, the method includes, prior to the determining step (a) or (b), providing the one or more biological samples obtained from the subject.

In certain embodiments, the method includes:

(a) determining a level of expression of one or more biomarkers of sensitivity selected from, e.g., the biomarkers of Table 3 in one or more biological samples obtained from the subject; and (b) determining a level of expression of one or more biomarkers of resistance selected from, e.g., the biomarkers of Table 4 in one or more biological samples obtained from the subject.

In particular embodiments, the difference between the levels of expression of the one or more biomarkers of sensitivity and the one or more biomarkers of resistance indicates whether the subject is responsive to the treatment.

In specific embodiments, the method further includes: (c) if the levels of expression of the one or more biomarkers of sensitivity or the one or more biomarkers of resistance indicate that the subject is responsive to irinotecan, administering an effective amount of the irinotecan to the subject.

In a fifth aspect, the invention features a method of treating a subject by:

(a) determining a level of expression of one or more biomarkers of sensitivity selected from, e.g., the biomarkers of Table 3 in one or more biological samples obtained from the subject; or (b) determining a level of expression of one or more biomarkers of resistance selected from, e.g., the biomarkers of Table 4 in one or more biological samples obtained from the subject; and (c) if the levels of expression of the one or more biomarkers of sensitivity or the one or more biomarkers of resistance indicate that the subject is responsive to irinotecan, administering an effective amount of irinotecan to the subject.

In some embodiments, the method includes:

(a) determining a level of expression of one or more biomarkers of sensitivity selected from, e.g., the biomarkers of Table 3 in one or more biological samples obtained from the subject; and (b) determining a level of expression of one or more biomarkers of resistance selected from, e.g., the biomarkers of Table 4 in one or more biological samples obtained from the subject.

In a sixth aspect, the invention features a method of treating a subject, the subject having previously been determined to be responsive to treatment with irinotecan by:

(a) determining a level of expression of one or more biomarkers of sensitivity selected from, e.g., the biomarkers of Table 3 in one or more biological samples obtained from the subject; or (b) determining a level of expression of one or more biomarkers of resistance selected from, e.g., the biomarkers of Table 4 in one or more biological samples obtained from the subject;

in which the levels of expression of the biomarker of sensitivity or the biomarker of resistance indicates whether the subject is responsive to the treatment;

the method including administering an effective amount of irinotecan to the subject.

In some embodiments of any of the above aspects, the method further includes administering one or more additional therapies to the subject.

In some embodiments, the one or more additional therapies is administered concurrently with the administration of irinotecan. In other embodiments, the one or more additional therapies is administered separately from the administration of irinotecan. In certain embodiments, the one or more additional therapies is administered prior to the administration of irinotecan. In alternate embodiments, the one or more additional therapies is administered after the administration of irinotecan. In particular embodiments, the one or more additional therapies is administered within 1 week of the administration of irinotecan (e.g., within about 15 minutes, 30 minutes, 1 hour, 2 hours, 3 hours, 4 hours, 5 hours, 6 hours, 8 hours, 10 hours, 12 hours, 24 hours, 36 hours, 2 days, 3 days, 4 days, 5 days, 6 days, or 1 week of the administration of irinotecan).

In some embodiments, the one or more additional therapies includes one or more additional therapeutic agents, surgery, or radiation therapy. In certain embodiments, the one or more additional therapies includes one or more additional therapeutic agents. In particular embodiments, the irinotecan is administered alone or in admixture with the one or more additional therapeutic agents.

In some embodiments, the one or more additional therapeutic agents is selected from the group consisting of: 5-FU, oxaliplatin, cetuximab, leucovorin, SN-38, everolimus, temsirolimus, bleomycin, lomustine, depsipeptide, carboplatin, bortezomib, erlotinib, gemcitabine, mitoxantrone, cisplatin, busulfan, epirubicin, arsenic trioxide, bendamustine, vincristine, fulvestrant, teniposide, adriamycin, decitabine, estramustine, other chemotherapeutic agents known in the art, and combinations thereof. In certain embodiments, the one or more additional therapeutic agents includes everolimus, temsirolimus, bleomycin, or lomustine. In particular embodiments, the one or more therapeutic agents includes 5-FU and leucovorin.

In some embodiments, the one or more additional therapeutic agents is administered to the subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin. In various embodiments, the one or more additional therapeutic agents is administered in dosage form.

In some embodiments, the irinotecan is administered to the subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin. In certain embodiments, the irinotecan is administered to the subject intravenously.

In some embodiments, the method further includes one or more additional administrations of an effective amount of irinotecan to the subject. In certain embodiments, the irinotecan is administered to the subject once weekly, once every other week, or once every three weeks. In particular embodiments, the irinotecan is administered to the subject in six week cycles (e.g., every six weeks). In various embodiments, the administration of irinotecan is repeated for at least 12 to 60 months (e.g., at least 12 months, 13 months, 14 months, 15 months, 16 months, 17 months, 18 months, 19 months, 20 months, 24 months, 25 months, 30 months, 36 months, 40 months, 48 months, 50 months, or 60 months).

In some embodiments, the irinotecan is administered in dosage form. In certain embodiments, the irinotecan is administered in doses of up to 125 $mg/m^2$, 180 $mg/m^2$, or 350 $mg/m^2$. (e.g., about 10 $mg/m^2$, 20 $mg/m^2$, 30 $mg/m^2$, 40 $mg/m^2$, 50 $mg/m^2$, 100 $mg/m^2$, 125 $mg/m^2$, 150 $mg/m^2$, 175 $mg/m^2$, 180 $mg/m^2$, 200 $mg/m^2$, 250 $mg/m^2$, 300 $mg/m^2$, or 350 $mg/m^2$).

In some embodiments, the determining step (a) or the determining step (b) occurs prior to the administration. In other embodiments, the determining step (a) or the determining step (b) occurs concurrent with the administration. In various embodiments, the determining step (a) or the determining step (b) occurs after the administration. In certain embodiments, the determining step (a) or the determining step (b) occurs multiple times.

In some embodiments, the administration occurs multiple times. In certain embodiments, each of the determining step (a) or the determining step (b) occurs prior to each of the administrations. In alternate embodiments, each of the determining step (a) or the determining step (b) occurs concurrent with each of the administrations. In further embodiments, each of the determining step (a) or the determining step (b) occurs after each of the administrations.

In some embodiments, the biomarker of sensitivity is PRF1. In certain embodiments, the expression level of the PRF1 indicates the sensitivity of the subject to the treatment.

In some embodiments, one or more of the biomarkers of sensitivity is selected from the group consisting of: PRF1, GZMB, PTPRC, PTPRC, PTPRCAP, PDE4DIP, ACAP1, PTPRC, S1PR1, and DOCK2; and/or one or more of the biomarkers of resistance is selected from the group consisting of: CCND1, LGALS3, INPP4B, TMEM97, TCF7L2, SFN, LAPTM4B, LSR, SFN, and TMEM97.

In some embodiments, one or more of the biomarkers of sensitivity is selected from the group consisting of: PRF1, GZMB, PTPRC, PTPRC, and PTPRCAP; and/or one or more of the biomarkers of resistance is selected from the group consisting of: CCND1, LGALS3, INPP4B, TMEM97, and TCF7L2.

In various embodiments, the difference between the expression levels of the one or more biomarkers of sensitivity and the one or more biomarkers of resistance indicates the sensitivity of the subject to the treatment. In certain embodiments, the expression levels of the one or more biomarkers of sensitivity in the subject having a statistically significant difference from the expression levels of the one or more biomarkers of sensitivity in a control indicates the sensitivity of the subject to the treatment. In particular embodiments, the expression levels of the one or more biomarkers of resistance in the subject having a statistically significant difference from the expression levels of the one or more biomarkers of resistance in a control indicates the resistance of the subject to the treatment. In specific embodiments, the expression level in the subject is significantly higher than in the control. In alternate embodiments, the expression level in the subject is significantly lower than in the control.

In a seventh aspect, the invention features a method of assessing the responsiveness of a subject to treatment with oxaliplatin by:

(a) determining a level of expression of one or more biomarkers of sensitivity selected from, e.g., the biomarkers of Table 5 in one or more biological samples obtained from the subject; or (b) determining a level of expression of one or more biomarkers of resistance selected from, e.g., the biomarkers of Table 6 in one or more biological samples obtained from the subject;

in which the levels of expression of the biomarker of sensitivity or the biomarker of resistance indicates whether the subject is responsive to the treatment.

In some embodiments, the method includes, prior to the determining of (a) or (b), providing the one or more biological samples obtained from the subject.

In some embodiments, the method includes:

(a) determining a level of expression of one or more biomarkers of sensitivity selected from, e.g., the biomarkers of Table 5 in one or more biological samples obtained from the subject; and (b) determining a level of expression of one or more biomarkers of resistance selected from, e.g., the biomarkers of Table 6 in one or more biological samples obtained from the subject.

In certain embodiments, the difference between the levels of expression of the one or more biomarkers of sensitivity and the one or more biomarkers of resistance indicates whether the subject is responsive to the treatment.

In some embodiments, the method further includes: (c) if the levels of expression of the one or more biomarkers of sensitivity or the one or more biomarkers of resistance indicate that the subject is responsive to oxaliplatin, administering an effective amount of the oxaliplatin to the subject.

In an eighth aspect, the invention features a method of treating a subject by:

(a) determining a level of expression of one or more biomarkers of sensitivity selected from, e.g., the biomarkers of Table 5 in one or more biological samples obtained from the subject; or (b) determining a level of expression of one or more biomarkers of resistance selected from, e.g., the biomarkers of Table 6 in one or more biological samples obtained from the subject;

(c) if the levels of expression of the one or more biomarkers of sensitivity or the one or more biomarkers of resistance indicate that the subject is responsive to oxaliplatin, administering an effective amount of oxaliplatin to the subject.

In some embodiments, the method includes the determining of (a) and the determining of (b).

In a ninth aspect, the invention features a method of treating a subject, the subject having previously been determined to be responsive to treatment with oxaliplatin by:

(a) determining a level of expression of one or more biomarkers of sensitivity selected from, e.g., the biomarkers of Table 5 in one or more biological samples obtained from the subject; or (b) determining a level of expression of one or more biomarkers of resistance selected from, e.g., the biomarkers of Table 6 in one or more biological samples obtained from the subject;

in which the levels of expression of the biomarker of sensitivity or the biomarker of resistance indicates whether the subject is responsive to the treatment;

the method including administering an effective amount of oxaliplatin to the subject.

In some embodiments, the method further includes administering one or more additional therapies to the subject. In certain embodiments, the one or more additional therapies is administered concurrently with the administration of oxaliplatin. In alternate embodiments, the one or more additional therapies is administered separately from the administration of oxaliplatin. In particular embodiments, the one or more additional therapies is administered prior to the administration of oxaliplatin. In other embodiments, the one or more additional therapies is administered after the administration of oxaliplatin. In certain embodiments, the one or more additional therapies is administered within 1 week of the administration of oxaliplatin.

In some embodiments, the one or more additional therapies includes one or more additional therapeutic agents, surgery, or radiation therapy. In certain embodiments, the one or more additional therapies includes one or more additional therapeutic agents. In particular embodiments, the oxaliplatin is administered alone or in admixture with the one or more additional therapeutic agents. In various embodiments, the one or more additional therapeutic agents is selected from the group consisting of: 5-FU, irinotecan, capecitabine, tegafur, cetuximab, leucovorin, SN-38, everolimus, temsirolimus, bleomycin, lomustine, depsipeptide, carboplatin, bortezomib, erlotinib, gemcitabine, mitoxantrone, cisplatin, busulfan, epirubicin, arsenic trioxide, bendamustine, vincristine, fulvestrant, teniposide, adriamycin, decitabine, and estramustine. In certain embodiments, the one or more additional therapeutic agents includes everolimus, temsirolimus, bleomycin, or lomustine. In particular embodiments, the one or more additional therapeutic agents includes 5-FU and leucovorin.

In some embodiments, the one or more additional therapeutic agents is administered to the subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin. In some embodiments, the one or more additional therapeutic agents is administered in dosage form.

In various embodiments, the oxaliplatin is administered to the subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin. In specific embodiments, the oxaliplatin is administered to the subject intravenously.

In some embodiments, the method further includes one or more additional administrations of an effective amount of oxaliplatin to the subject. In certain embodiments, the oxaliplatin is administered to the subject once every two weeks. In particular embodiments, the oxaliplatin is administered to the subject once every two weeks for up to six months. In various embodiments, the administration of oxaliplatin is repeated for at least 12 to 60 months (e.g., at least 12 months, 13 months, 14 months, 15 months, 16 months, 17 months, 18 months, 19 months, 20 months, 24 months, 25 months, 30 months, 36 months, 40 months, 48 months, 50 months, or 60 months).

In some embodiments, the oxaliplatin is administered in dosage form. In certain embodiments, the oxaliplatin is administered in doses of up to 85 $mg/m^2$. (e.g., about 10 $mg/m^2$, 20 $mg/m^2$, 30 $mg/m^2$, 40 $mg/m^2$, 50 $mg/m^2$, 60 $mg/m^2$, 70 $mg/m^2$, 80 $mg/m^2$, or 86 $mg/m^2$).

In some embodiments, the determining of (a) or the determining of (b) occurs prior to the administration. In alternate embodiments, the determining step (a) or the determining step (b) occurs concurrent with the administration. In various embodiments, the determining step (a) or the determining step (b) occurs after the administration. In certain embodiments, the determining step (a) or the determining step (b) occurs multiple times.

In some embodiments, the administration occurs multiple times. In certain embodiments, each of the determining step (a) or the determining step (b) occurs prior to each of the administrations. In alternative embodiments, each of the determining step (a) or the determining step (b) occurs concurrent with each of the administrations. In various embodiments, each of the determining step (a) or the determining step (b) occurs after each of the administrations.

In some embodiments of any of the above aspects, the biomarker of sensitivity is selected from MRPL16 and at least a second biomarker of sensitivity selected from the biomarkers of Table 5. In certain embodiments, the second biomarker of sensitivity is selected from the group consisting of: ANP32A, SRSF2, PDSS1, PRIM1, HNRNPA1, NDUFAB1, GLTSCR2, RNPS1, and ICAM2. In particular embodiments, the second biomarker of sensitivity is selected from the group consisting of: ANP32A, SRSF2, PDSS1, and PRIM1. In specific embodiments, the second biomarkers of sensitivity is ANP32A.

In some embodiments, the biomarker of sensitivity is selected from MRPL16 and the biomarker of resistance is selected from one or more of the biomarkers of Table 6. In certain embodiments, the biomarker of resistance is selected from the group consisting of: LPP, RHOC, CAPN2, FLNA, WDR1, FLNA, ACTN1, CNN3, FLNA, and ACTN1. In particular embodiments, the biomarker of resistance is selected from the group consisting of: LPP, RHOC, CAPN2, FLNA, and WDR1. In specific embodiments, the biomarker of resistance is LPP.

In some embodiments, one or more of the biomarkers of sensitivity is selected from the group consisting of: MRPL16, ANP32A, SRSF2, PDSS1, PRIM1, HNRNPA1, NDUFAB1, GLTSCR2, RNPS1, and ICAM2; and/or one or more of the biomarkers of resistance is selected from the group consisting of: LPP, RHOC, CAPN2, FLNA, WDR1, FLNA, ACTN1, CNN3, FLNA, and ACTN1.

In some embodiments, one or more of the biomarkers of sensitivity is selected from the group consisting of: MRPL16, ANP32A, SRSF2, PDSS1, and PRIM1; and/or one or more of the biomarkers of resistance is selected from the group consisting of: LPP, RHOC, CAPN2, FLNA, and WDR1.

In some embodiments, the difference between the expression levels of the one or more biomarkers of sensitivity and the one or more biomarkers of resistance indicates the sensitivity of the subject to the treatment.

In some embodiments, the method further involves predicting sensitivity of the subject to combination treatment with oxaliplatin and 5-FU, and the method further includes:

(c) determining a level of expression of one or more biomarkers of resistance to 5-FU selected from the biomarkers of Table 2 in one or more biological samples obtained from the subject; in which the biomarker of sensitivity is MRPL16. In certain embodiments, the one or more biomarkers of resistance to 5-FU is selected from the group consisting of: NT5E, CNN3, ACTN1, FLNA, ATP2B4, CYR61, LGALS1, RHOC, RAB32, and TMEM158. In particular embodiments, the one or more biomarkers of resistance to 5-FU is selected from the group consisting of: NT5E, CNN3, ACTN1, FLNA, and ATP2B4. In a specific embodiment, the biomarker of resistance to 5-FU is NT5E.

In particular embodiments, the expression level of NT5E is determined using a probe capable of detecting a nucleic acid having the sequence of, e.g., SEQ ID NO. 94, 1015, 1016, 1683, 2064, 2207, 2316, 2446, 2714, or 2778. In specific embodiments, the probe includes a sequence having at least 5 continuous nucleotides and at least 75% (e.g., 75%, 80%, 85%, 90%, 95%, 99%, or 100%) identity to a sequence complementary to, e.g., SEQ ID NO. 94, 1015, 1016, 1683, 2064, 2207, 2316, 2446, 2714, or 2778.

In certain embodiments, the difference between the expression levels of the MRPL16 and the one or more biomarkers of resistance to 5-FU indicate the sensitivity of the subject to the combination treatment with oxaliplatin and 5-FU.

In various embodiments, the expression levels of the one or more biomarkers of sensitivity in the subject having a statistically significant difference from the expression levels of the one or more biomarkers of sensitivity in a control indicates the sensitivity of the subject to the treatment. In some embodiments, the expression levels of the one or more biomarkers of resistance in the subject having a statistically significant difference from the expression levels of the one or more biomarkers of resistance in a control indicates the resistance of the subject to the treatment. In certain embodiments, the expression level in the subject is significantly higher than in the control. In alternate embodiments, the expression level in the subject is significantly lower than in the control.

In some embodiments of any of the aspects of the invention, the method further includes determining the expression level of one or more additional biomarkers (e.g., biomarkers of cancer, e.g., colon cancer or breast cancer). In some embodiments, the one or more additional biomarkers is selected from the group consisting of: carcinoembryonic antigen (CEA), BRAF, KRAS, Fas-ligand, p53, Ki-67, thymidylate-synthase, dihydropyrimidine dehydrogenase, thymidine phosphorylase, microsatellite instability (MIS), and 18q allelic loss of heterozygosity (LOH18q). In certain embodiments, an elevated level of the one or more additional biomarkers indicates that the subject is responsive to the treatment.

In some embodiments of any of the aspects of the invention, the method further includes, prior to the determining of (a) or (b), amplification of the biomarkers from the one or more biological samples. In some embodiments, the method further includes, prior to the determining of (a) or (b), reverse transcription of the biomarkers from the one or more biological samples. In certain embodiments, the product of the amplification or the reverse transcription is cDNA.

In some embodiments of any of the aspects of the invention, the one or more biological samples includes cDNA.

In some embodiments of any of the aspects of the invention, the levels of expression are determined using a microarray or sequencing. In some embodiments, the microarray includes a plurality of nucleic acid probes. In certain embodiments, one or more of the nucleic acid probes (e.g., each of the nucleic acid probes) are configured to hybridize to a target RNA molecule or a target cDNA molecule (e.g., an RNA or DNA (e.g., cDNA) molecule corresponding to one or more of the biomarkers of sensitivity and/or resistance of any one or more of Tables 1-12). In particular embodiments, the one or more of the nucleic acid probes (e.g., each of the nucleic acid probes) includes a sequence having at least, e.g., 75%, 85%, 90%, 95%, 98%, 99%, or 100% sequence identity to a continuous sequence (e.g., a sequence of at least 5, 10, 15, 20, or more nucleic acids in length; such as, e.g., 15 nucleic acids in length) within the target nucleic acid molecule (e.g., a target RNA or DNA (e.g., cDNA) molecule, such as a molecule having the sequence of one or more of the biomarkers of sensitivity and/or resistance of of any one or more of Tables 1-12). In other embodiments, the one or more of the nucleic acid probes (e.g., each of the nucleic acid probes) includes a sequence having at least, e.g., 75%, 85%, 90%, 95%, 98%, 99%, or 100% sequence identity to the complement of a continuous sequence (e.g., a sequence of at least 5, 10, 15, 20, or more nucleic acids in length; such as, e.g., 15 nucleic acids in length) within the target nucleic acid molecule (e.g a target RNA or DNA (e.g., cDNA) molecule, such as a molecule having the sequence of one or more of the biomarkers of sensitivity and/or resistance of any one or more of Tables 1-12). In specific embodiments, each of the target RNA molecules includes at least one of the biomarkers (e.g., an RNA molecule encoding a biomarker protein or transcribed from a biomarker gene). In alternate embodiments, each of the target cDNA molecules is derived from at least one of the biomarkers (e.g., a cDNA reverse-transcribed from a biomarker RNA molecule or having a substantially identical nucleotide sequence to the coding sequence of a biomarker gene).

In some embodiments, each of the nucleic acid probes has a length of, e.g., about 5 nucleotides (nt), 10 nt, 15 nt, 20 nt, 25 nt, 30 nt, 50 nt, 75 nt, 100 nt, 150 nt, or 200 nt (e.g., at least 15 nt). In various embodiments, the nucleic acid probes are single-stranded. In certain embodiments, the nucleic acid probes include DNA, cDNA, RNA, a nucleic acid analog, or a combination thereof.

In some embodiments, the nucleic acid probes are labeled. In certain embodiments, each of the nucleic acid probes is labeled with at least one of a dye molecule, fluorescent molecule, small molecule, nucleic acid barcode, or polypeptide. In particular embodiments, the label is a non-naturally occurring label.

In some embodiments, the microarray is an Almac array. In alternate embodiments, the microarray is an Affymetrix array.

In some embodiments, the sequencing is performed by RNA-Seq. In certain embodiments, the sequencing is performed by 454 pyrosequencing, Illumina sequencing by synthesis, SOLiD sequencing, Ion Torrent sequencing, or PacBio RS sequencing. In particular embodiments, the sequencing includes labeling the one or more biological samples with a plurality of non-naturally occurring labels. In specific embodiments, each of the non-naturally occurring labels are selected from the group consisting of a dye molecule, fluorescent molecule, small molecule, nucleic acid barcode, and polypeptide.

In some embodiments of any of the aspects of the invention, the levels of expression of the one or more biomarkers of sensitivity and/or the levels of expression of the one or more biomarkers of resistance are determined using a NanoString nCounter system.

In some embodiments of any of the aspects of the invention, the determining step (a) and the determining step (b) are performed using the same biological sample. In some embodiments, the determining step (a) and the determining step (b) are performed using different biological samples. In various embodiments, one or more of the biological samples is formalin-fixed paraffin embedded (FFPE) tissue. In some embodiments, one or more of the biological samples is fresh frozen tissue. In certain embodiments, the one or more of the biological samples is obtained from a tumor. In particular embodiments, the one or more of the biological samples includes a tumor biopsy.

In some embodiments of any of the aspects of the invention, the level of expression of the biomarkers of sensitivity and/or the biomarkers of resistance is determined using a device or a kit (e.g., a device or a kit as described herein).

In some embodiments of any of the aspects of the invention, the subject is suffering from cancer or has a predisposition to cancer. In certain embodiments, a cancer has been resected from the subject.

In some embodiments, the cancer is selected from the group consisting of: colorectal cancer, leukemia (e.g., acute myeloid leukemia, acute lymphoid leukemia, chronic myeloid leukemia, chronic lymphocytic leukemia, acute myeloblastic leukemia, acute promyelocytic leukemia, acute myelomonocytic leukemia, acute monocytic leukemia, acute erythroleukemia, or chronic leukemia), myeloma (e.g., multiple myeloma), myelodysplastic syndrome, lymphoma (e.g., diffuse large B-cell lymphoma, cutaneous T-cell lymphoma, peripheral T-cell lymphoma, Hodgkin's lymphoma, non-Hodgkin's lymphoma, Waldenstrom's macroglobulinemia, or lymphocytic lymphoma), cervical cancer, prostate cancer, esophageal cancer, melanoma, glioma (e.g., oligodendroglioma), pancreatic cancer (e.g., adenosquamous carcinoma, signet ring cell carcinoma, hepatoid carcinoma, colloid carcinoma, islet cell carcinoma, or pancreatic neuroendocrine carcinoma), ovarian cancer (e.g., ovarian adenocarcinoma or embryonal carcinoma), gastrointestinal stromal tumor, sarcoma (e.g., fibrosarcoma, myxosarcoma, liposarcoma, chondrosarcoma, osteogenic sarcoma, angiosarcoma, endotheliosarcoma, lymphangiosarcoma, lymphangioendotheliosarcoma, leiomyosarcoma, Ewing's sarcoma, or rhabdomyosarcoma), breast cancer, ER-positive cancer, bladder cancer, head and neck cancer (e.g., squamous cell carcinoma of the head and neck), lung cancer (e.g., non-small cell lung carcinoma, large cell carcinoma, bronchogenic carcinoma, or papillary adenocarcinoma), metastatic cancer, oral cavity cancer, uterine cancer, testicular cancer (e.g., seminoma or embryonal carcinoma), skin cancer (e.g., squamous cell carcinoma or basal cell carcinoma), thyroid cancer (e.g., papillary carcinoma or medullary carcinoma), brain cancer (e.g., astrocytoma or craniopharyngioma), stomach cancer, intra-epithelial cancer, bone cancer, biliary tract cancer, eye cancer, liver cancer (e.g., hepatocellular carcinoma or hepatoma), larynx cancer, kidney cancer (e.g., renal cell carcinoma or Wilms tumor), gastric cancer, blastoma (e.g., nephroblastoma, medulloblastoma, hemangioblastoma, neuroblastoma, or retinoblastoma), polycythemia vera, chordoma, synovioma, mesothelioma, adenocarcinoma, sweat gland carcinoma, sebaceous gland carcinoma, cystadenocarcinoma, bile duct carcinoma, choriocarcinoma, epithelial carcinoma, ependymoma, pinealoma, acoustic neuroma, schwannoma, meningioma, pituitary adenoma, nerve sheath tumor, cancer of the small intestine, cancer of the endocrine system, cancer of the penis, cancer of the urethra, cutaneous or intraocular melanoma, a gynecologic tumor, solid tumors of childhood, and neoplasms of the central nervous system.

In certain embodiments, the cancer is colorectal cancer. In particular embodiments, the colorectal cancer is colon cancer or rectal cancer. In specific embodiments, the colon cancer is selected from the group consisting of: adenocarcinoma, gastrointestinal carcinoid tumor, primary colorectal lymphoma, leiomyosarcoma, colorectal melanoma, and squamous cell carcinoma. In one embodiment, the colon cancer is adenocarcinoma. In particular embodiments, the colon cancer is Stage 0, Stage I, Stage II, Stage III, or Stage IV colon cancer. In one embodiment, the colon cancer is Stage II colon cancer. In another embodiment, the colon cancer is Stage III colon cancer.

In certain embodiments, the cancer is breast cancer. In particular embodiments, the breast cancer is medullary carcinoma. In specific embodiments, the breast cancer is Stage 0, Stage I, Stage II, Stage III, or Stage IV breast cancer.

In a tenth aspect, the invention features a method of assessing the responsiveness of a subject to treatment with 5-FU, irinotecan, or oxaliplatin by:

(a) determining a level of expression of one or more biomarkers of sensitivity in one or more biological samples obtained from the subject; or (b) determining a level of expression of one or more biomarkers of resistance in one or more biological samples obtained from the subject; in which the one or more biomarkers of sensitivity includes a gene determined to have at least a 0.25 Pearson correlation between the mRNA expression level of the gene and growth inhibition of a cultured cell exposed to the drug, and/or the one or more biomarkers of resistance includes a gene determined to have at least a −0.25 Pearson correlation between the mRNA expression level of the gene and growth inhibition of a cultured cell exposed to the drug; and in which the levels of expression of the biomarker of sensitivity or the biomarker of resistance indicate whether the subject is responsive to the treatment.

In some embodiments of any of the aspects of the invention, responsiveness (e.g., sensitivity or resistance) to treatment with 5-FU also indicates responsiveness to treatment with a 5-FU analog (e.g., a prodrug, derivative, metabolite, or enantiomer of 5-FU). In certain embodiments, if a subject is determined to be sensitive to 5-FU, then the subject is also determined to be sensitive to a 5-FU analog. In other embodiments, if a subject is determined to be resistant to 5-FU, then the subject is also determined to be resistant to a 5-FU analog. In particular embodiments, the 5-FU analog is a 5-FU prodrug (e.g., capecitabine or tegafur).

In some embodiments of any of the aspects of the invention, responsiveness (e.g., sensitivity or resistance) to treatment with irinotecan also indicates responsiveness to treatment with an irinotecan analog (e.g., a prodrug, derivative, metabolite, or enantiomer of irinotecan). In certain embodiments, if a subject is determined to be sensitive to irinotecan, then the subject is also determined to be sensitive to an irinotecan analog. In other embodiments, if a subject is determined to be resistant to irinotecan, then the subject is also determined to be resistant to an irinotecan analog.

In some embodiments of any of the aspects of the invention, responsiveness (e.g., sensitivity or resistance) to treatment with oxaliplatin also indicates responsiveness to treatment with an oxaliplatin analog (e.g., a prodrug, derivative, metabolite, or enantiomer of oxaliplatin). In certain embodiments, if a subject is determined to be sensitive to oxaliplatin, then the subject is also determined to be sensitive to an oxaliplatin analog. In other embodiments, if a subject is determined to be resistant to oxaliplatin, then the subject is also determined to be resistant to an oxaliplatin analog.

In an eleventh aspect, the invention features a device for detecting the level of expression of one or more biomarkers (e.g., biomarkers of sensitivity and/or resistance to a target drug, e.g., 5-FU, irinotecan, or oxaliplatin, or derivatives, analogs, or prodrugs thereof), which includes:

at least one single-stranded nucleic acid having at least 75% sequence identity (e.g., 75%, 85%, 90%, 95%, 98%, 99%, or 100% sequence identity) to a nucleic acid sequence complementary or identical to at least 5 consecutive nucleotides of one or more biomarkers selected from the biomarkers of Table 1 or 2;

in which at least one single-stranded nucleic acid is sufficient for the detection of the level of expression of the one or more biomarkers, and the device allows for specific hybridization between the single-stranded nucleic acid and the one or more biomarkers or complementary nucleic acids thereof.

In a twelfth aspect, the invention features a device configured to perform a method (e.g., a method of assessing the responsiveness of a subject to treatment with, e.g., 5-FU, irinotecan, or oxaliplatin; or a method of treating a subject) described herein.

In a thirteenth aspect, the invention features a kit including:

(i) reagents for collecting nucleic acids from a biological sample, for example, a biological sample obtained from a subject (e.g., a subject suffering from or susceptible to cancer, e.g., colon cancer or breast cancer);

(ii) reagents for amplifying the nucleic acids to produce an amplified sample; and/or (iii) at least one device of the present invention.

In a fourteenth aspect, the invention features a method for identifying biomarkers of sensitivity or resistance to a target drug by:

(i) contacting a first cell with an effective amount of the target drug;

(ii) incubating the first cell and a second cell not contacted with an effective amount of the target drug under identical conditions in parallel;

(iii) measuring the growth inhibition values (GI50) for the first cell and the second cell;

(iv) obtaining the gene expression profiles (e.g., using a microarray, sequencing, and/or a NanoString nCounter system) for the first cell and the second cell; and (v) determining a correlation (e.g., a Pearson correlation) comparing the gene expression profiles for the first cell and the second cell with respect to their GI50 values;

in which the correlation between the expression level of a gene from the gene expression profiles of the first cell and the second cell and the GI50 values for the first cell and the second cell being, e.g., at least 0.25 indicates that the gene is a biomarker of sensitivity, and the correlation between the expression level of a gene from the gene expression profiles of the first cell and the second cell and the GI50 values for the first cell and the second cell being, e.g., −0.25 or less indicates that the gene is a biomarker of resistance.

In all aspects of the invention, the level of expression of the biomarkers of sensitivity to 5-FU can be determined using a probe capable of detecting a nucleic acid having the sequence of at least one of SEQ ID NOs. 1-93 and the sequences listed in Table 7. In some embodiments, the probe includes a sequence including at least 5 (e.g., at least 15) continuous nucleotides and at least 75% identity (e.g., 75%, 80%, 85%, 90%, 95%, 99%, or 100%) to a sequence identical to or complementary to at least one of SEQ ID NOs. 1-93 and the sequences listed in Table 7.

In all aspects of the invention, the level of expression of the biomarkers of resistance to 5-FU can be determined using a probe capable of detecting a nucleic acid having the sequence of at least one of SEQ ID NOs. 94-208 and the sequences listed in Table 8. In some embodiments, the probe includes a sequence including at least 5 (e.g., at least 15) continuous nucleotides and at least 75% identity (e.g., 75%, 80%, 85%, 90%, 95%, 99%, or 100%) to a sequence identical to or complementary to at least one of SEQ ID NOs. 94-208 and the sequences listed in Table 8.

In all aspects of the invention, the level of expression of the biomarkers of sensitivity to irinotecan can be determined using a probe capable of detecting a nucleic acid having the sequence of at least one of SEQ ID NOs. 209-353 and the sequences listed in Table 9. In some embodiments, the probe includes a sequence including at least 5 (e.g., at least 15) continuous nucleotides and at least 75% identity (e.g., 75%, 80%, 85%, 90%, 95%, 99%, or 100%) to a sequence identical to or complementary to at least one of SEQ ID NOs. 209-353 and the sequences listed in Table 9.

In all aspects of the invention, the level of expression of the biomarkers of resistance to irinotecan can be determined using a probe capable of detecting a nucleic acid having the sequence of at least one of SEQ ID NOs. 354-398 and the sequences listed in Table 10. In some embodiments, the probe includes a sequence including at least 5 (e.g., at least 15) continuous nucleotides and at least 75% identity (e.g., 75%, 80%, 85%, 90%, 95%, 99%, or 100%) to a sequence identical to or complementary to at least one of SEQ ID NOs. 354-398 and the sequences listed in Table 10.

In all aspects of the invention, the level of expression of the biomarkers of sensitivity to oxaliplatin can be determined using a probe capable of detecting a nucleic acid having the sequence of at least one of SEQ ID NOs. 399-578 and the sequences listed in Table 11. In some embodiments, the probe includes a sequence including at least 5 (e.g., at least 15) continuous nucleotides and at least 75% identity (e.g., 75%, 80%, 85%, 90%, 95%, 99%, or 100%) to a sequence identical to or complementary to at least one of SEQ ID NOs. 399-578 and the sequences listed in Table 11.

In all aspects of the invention, the level of expression of the biomarkers of resistance to oxaliplatin can be determined using a probe capable of detecting a nucleic acid having the sequence of at least one of SEQ ID NOs. 579-826 and the sequences listed in Table 12. In some embodiments, the probe includes a sequence including at least 5 (e.g., at least 15) continuous nucleotides and at least 75% identity (e.g., 75%, 80%, 85%, 90%, 95%, 99%, or 100%) to a sequence identical to or complementary to at least one of SEQ ID NOs. 579-826 and the sequences listed in Table 12.

In all aspects of the invention, the expression level of NT5E can be determined using a probe capable of detecting a nucleic acid having the sequence of any one or more of, e.g., SEQ ID NO. 94, 1015, 1016, 1683, 2064, 2207, 2316, 2446, 2714, and 2778, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to, or complementary to, e.g., SEQ ID NO. 94, 1015, 1016, 1683, 2064, 2207, 2316, 2446, 2714, or 2778.

In all aspects of the invention, the expression level of CNN3 can be determined, e.g., using a probe capable of detecting a nucleic acid having the sequence of any one or more of, e.g., SEQ ID NO. 95, 1157, 1476, or 1847, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to, or complementary to, e.g., SEQ ID NO. 95, 1157, 1476, or 1847.

In all aspects of the invention, the expression level of ACTN1 can be determined, e.g., using a probe capable of detecting a nucleic acid having the sequence of any one or more of, e.g., SEQ ID NO. 96, 934, 2203, 2469, 2737, 2816, or 2817, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to, or complementary to, e.g., SEQ ID NO. 96, 934, 2203, 2469, 2737, 2816, or 2817.

In all aspects of the invention, the expression level of FLNA can be determined, e.g., using a probe capable of detecting a nucleic acid having the sequence of any one or more of, e.g., SEQ ID NO. 97, 1387, 1490, 1542, 1621, 1773, 1867, 1902, 1960, 2048, 2051, 2347, or 2348, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 97, 1387, 1490, 1542, 1621, 1773, 1867, 1902, 1960, 2048, 2051, 2347, or 2348.

In all aspects of the invention, the expression level of ATP2B4 can be determined, e.g., using a probe capable of detecting a nucleic acid having the sequence of any one or more of, e.g., SEQ ID NO. 98, 1498, 1845, 2056, 2284, 2285, 2523, or 2627, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 98, 1498, 1845, 2056, 2284, 2285, 2523, or 2627.

In all aspects of the invention, the expression level of APRT can be determined, e.g., using a probe capable of detecting a nucleic acid having the sequence of any one or more of, e.g., SEQ ID NO. 1 or 1201, or a complement thereof. In some embodiments, the probe includes a sequence having at least 5 continuous nucleotides and at least 75% (e.g., 75%, 80%, 85%, 90%, 95%, 99%, or 100%) identity to a sequence identical to or complementary to, e.g., SEQ ID NO. 1 or 1201.

In all aspects of the invention, the expression level of GSR can be determined, e.g., using a probe capable of detecting a nucleic acid having the sequence of any one or more of, e.g., SEQ ID NO. 2, 907, 1148, 1722, or 2750, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 2, 907, 1148, 1722, or 2750.

In all aspects of the invention, the expression level of TUFM can be determined, e.g., using a probe capable of detecting a nucleic acid having the sequence of any one or more of, e.g., SEQ ID NO. 3 or 1146, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 3 or 1146.

In all aspects of the invention, the expression level of MRPS2 can be determined, e.g., using a probe capable of detecting a nucleic acid having the sequence of any one or more of, e.g., SEQ ID NO. 4 or 839, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 4 or 839.

In all aspects of the invention, the expression level of MTHFD2 can be determined, e.g., using a probe capable of detecting a nucleic acid having the sequence of any one or more of, e.g., SEQ ID NO. 5 or 1189, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 5 or 1189.

In all aspects of the invention, the expression level of PRF1 can be determined, e.g., using a probe capable of detecting a nucleic acid having the sequence of any one or more of, e.g., SEQ ID NO. 209, 2314, 2315, or 2881, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 209, 2314, 2315, or 2881.

In all aspects of the invention, the expression level of GZMB can be determined, e.g., using a probe capable of detecting a nucleic acid having the sequence of any one or more of, e.g., SEQ ID NO. 210, 1681, or 1682, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 210, 1681, or 1682.

In all aspects of the invention, the expression level of PTPRC can be determined, e.g., using a probe capable of detecting a nucleic acid having the sequence of any one or more of, e.g., SEQ ID NO. 211, 212, 1020, 1632, 1675, 1998, 1999, 2535, 2636, or 2797, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 211, 212, 1020, 1632, 1675, 1998, 1999, 2535, 2636, or 2797.

In all aspects of the invention, the expression level of PTPRCAP can be determined, e.g., using a probe capable of detecting a nucleic acid having the sequence of any one or more of, e.g., SEQ ID NO. 213, 1645, or 1646, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 213, 1645, or 1646.

In all aspects of the invention, the expression level of CCND1 can be determined, e.g., using a probe capable of detecting a nucleic acid having the sequence of any one or more of, e.g., SEQ ID NO. 354, 1592, 1593, 1679, 1727, 1752, 1817, 2013, or 2640, or a complement thereof. In some embodiments, the probe includes a sequence having at least 5 (e.g., at least 15) continuous nucleotides and at least 75% (e.g., 75%, 80%, 85%, 90%, 95%, 99%, or 100%)

identity to a sequence identical to or complementary to, e.g., SEQ ID NO. 354, 1592, 1593, 1679, 1727, 1752, 1817, 2013, or 2640.

In all aspects of the invention, the expression level of LGALS3 can be determined, e.g., using a probe capable of detecting a nucleic acid having the sequence of any one or more of, e.g., SEQ ID NO. 355, 1299, 1334, 1335, or 2069, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 355, 1299, 1334, 1335, or 2069.

In all aspects of the invention, the expression level of INPP4B can be determined, e.g., using a probe capable of detecting a nucleic acid having the sequence of any one or more of, e.g., SEQ ID NO. 356, 919, 1453, 1616, 1617, 2199, 2386, 2625, or 2626, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 356, 919, 1453, 1616, 1617, 2199, 2386, 2625, or 2626.

In all aspects of the invention, the expression level of TMEM97 can be determined, e.g., using a probe capable of detecting a nucleic acid having the sequence of any one or more of, e.g., SEQ ID NO. 357, 966, 2532, or 2566, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 357, 966, 2532, or 2566.

In all aspects of the invention, the expression level of TCF7L2 can be determined, e.g., using a probe capable of detecting a nucleic acid having the sequence of any one or more of, e.g., SEQ ID NO. 358, 955, 1536, 1852, 2081, 2099, 2171, 2192, 2219, 2539, 2575, 2665, or 2880, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 358, 955, 1536, 1852, 2081, 2099, 2171, 2192, 2219, 2539, 2575, 2665, or 2880.

In all aspects of the invention, the expression level of MRPL16 can be determined, e.g., using a probe capable of detecting a nucleic acid having the sequence of any one or more of, e.g., SEQ ID NO. 399 or 1144, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 399 or 1144.

In all aspects of the invention, the expression level of ANP32A can be determined, e.g., using a probe capable of detecting a nucleic acid having the sequence of any one or more of, e.g., SEQ ID NO. 400, 1921, 2357, 2358, 2736, 2799, or 2800, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 400, 1921, 2357, 2358, 2736, 2799, or 2800.

In all aspects of the invention, the expression level of SRSF2 can be determined, e.g., using a probe capable of detecting a nucleic acid having the sequence of, e.g., SEQ ID NO. 401, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 401.

In all aspects of the invention, the expression level of PDSS1 can be determined, e.g., using a probe capable of detecting a nucleic acid having the sequence of any one or more of, e.g., SEQ ID NO. 402, 862, or 2058, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 402, 862, or 2058.

In all aspects of the invention, the expression level of PRIM1 can be determined, e.g., using a probe capable of detecting a nucleic acid having the sequence of any one or more of, e.g., SEQ ID NO. 403, 2266, or 2267, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 403, 2266, or 2267.

In all aspects of the invention, the expression level of LPP can be determined, e.g., using a probe capable of detecting a nucleic acid having the sequence of any one or more of, e.g., SEQ ID NO. 579, 984, 1031, 1437, 1693, 1731, 1828, 1831, 1872, 2040, 2063, 2104, 2109, 2119, 2123, 2160, 2197, 2400, 2401, 2618, 2784, 2852, or 2853, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 579, 984, 1031, 1437, 1693, 1731, 1828, 1831, 1872, 2040, 2063, 2104, 2109, 2119, 2123, 2160, 2197, 2400, 2401, 2618, 2784, 2852, or 2853.

In all aspects of the invention, the expression level of RHOC can be determined, e.g., using a probe capable of detecting a nucleic acid having the sequence of, e.g., SEQ ID NO. 580, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 580.

In all aspects of the invention, the expression level of CAPN2 can be determined, e.g., using a probe capable of detecting a nucleic acid having the sequence of any one or more of, e.g., SEQ ID NO. 581, 1521, 1552, 1900, 1965, 2154, 2233, 2234, or 2826, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 581, 1521, 1552, 1900, 1965, 2154, 2233, 2234, or 2826.

In all aspects of the invention, the expression level of FLNA can be determined, e.g., using a probe capable of detecting a nucleic acid having the sequence of any one or more of, e.g., SEQ ID NO. 582, 584, 587, 1387, 1490, 1542, 1621, 1773, 1867, 1902, 1960, 2048, 2051, 2347, or 2348, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 582, 584, 587, 1387, 1490, 1542, 1621, 1773, 1867, 1902, 1960, 2048, 2051, 2347, or 2348.

In all aspects of the invention, the expression level of WDR1 can be determined, e.g., using a probe capable of detecting a nucleic acid having the sequence of any one or more of, e.g., SEQ ID NO. 583, 894, 1135, 1136, 1390, 2194, 2335, 2506, 2839, or 2862, or a complement thereof. In some embodiments, the probe includes a sequence having at least 5 (e.g., at least 15) continuous nucleotides and at least 75% (e.g., 75%, 80%, 85%, 90%, 95%, 99%, or 100%) identity to a sequence identical to or complementary to, e.g., SEQ ID NO. 583, 894, 1135, 1136, 1390, 2194, 2335, 2506, 2839, or 2862.

Definitions

As used herein, "5-fluorouracil," "fluorouracil," and "5-FU" refer to a compound having the structure of Formula (I), or to formulations containing such a compound.

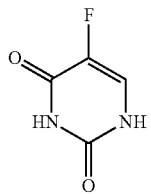

Formula (I)

A "5-FU analog" means any therapeutic agent having a structure similar to the compound of Formula (I) and/or biological activity the same or similar to that of the compound of Formula (I), for example, prodrugs (e.g., capecitabine and tegafur), derivatives, metabolites, and enantiomers of Formula (I). If a specific formulation of 5-FU or a 5-FU analog is meant, that formulation is referenced by its specific name.

The term "irinotecan," as used herein, refers to a compound having the structure of Formula (II), or to formulations containing such a compound.

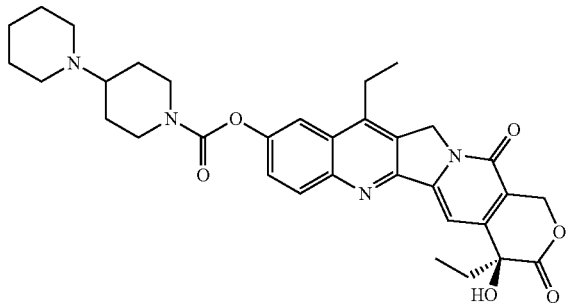

Formula (II)

An "irinotecan analog" means any therapeutic agent having a structure similar to the compound of Formula (II) and/or biological activity the same or similar to that of the compound of Formula (II), for example, prodrugs, derivatives, metabolites, and enantiomers of Formula (II). If a specific formulation of irinotecan or an irinotecan analog is meant, that formulation is referenced by its specific name.

By "oxaliplatin" is meant a compound having the structure of Formula (III), or to formulations containing such a compound.

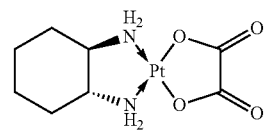

Formula (III)

An "oxaliplatin analog" means any therapeutic agent having a structure similar to the compound of Formula (III) and/or biological activity the same or similar to that of the compound of Formula (III), for example, prodrugs, derivatives, metabolites, and enantiomers of Formula (III). If a specific formulation of oxaliplatin or an oxaliplatin analog is meant, that formulation is referenced by its specific name.

The terms "capecitabine" and "Xeloda," as used herein, mean a compound having the structure of Formula (IV), or to formulations containing such a compound.

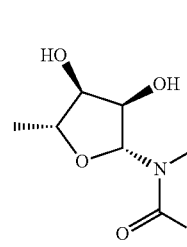

Formula (IV)

Capecitabine compounds can be, e.g., metabolized into 5-FU in the body and can thus be used as a prodrug for 5-FU, such as for the treatment of cancers, e.g., colon cancer or breast cancer.

The term "tegafur," as used herein, means a compound having the structure of Formula (V), or to formulations containing such a compound.

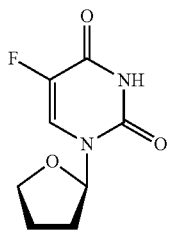

Formula (V)

Tegafur compounds can be, e.g., metabolized into 5-FU in the body and can thus be used as a prodrug for 5-FU. Tegafur can be used according the methods of the invention, for example, as a component of the combination drug tegafur/uracil for the treatment of, e.g., cancers (e.g., colon cancer or breast cancer).

The terms "responsive" and "responsiveness," as used herein with respect to a subject's responsiveness to a treatment, e.g., treatment with a compound, such as an anti-cancer agent (e.g., 5-FU, irinotecan, or oxaliplatin), or treatment with radiation, refer to the likelihood that the treatment has (e.g., induces) a desired effect, or alternatively refers to the strength of a desired effect caused or induced by the treatment in a cell, a tumor, or subject (e.g., a mammal, such as a human). For example, the desired effect can include inhibition of the growth of a cell, e.g., a cancer cell, in vitro or in a tumor, person, or living organism by more than 10%, 20%, 30%, 40%, 50%, 60%, 70%, 80%, 90%, or 100% relative to the growth of a cell not exposed to the treatment. The desired effect can also include reduction in tumor mass by, e.g., about 10%, 20%, 30%, 40%, 50%, 60%, 70%, 80%, 90%, or 100%. Responsiveness to treatment may be determined by a cell-based assay that measures the growth of treated cells as a function of the cells' absorbance of an incident light beam as used to perform the NCI60 assays described herein. In this example, lesser absorbance indicates lesser cell growth, and thus, sensitivity to the treatment. A greater reduction in growth indicates more sensitivity to the treatment. According to the present invention, "responsiveness" is a measure of the sensitivity or resistance of a subject to a treatment, e.g., for cancer, for example, by treatment with a target drug (e.g., 5-FU, irinotecan, and oxaliplatin). A "sensitive" or "responsive" subject is one in which the treatment will produce the desired effect (e.g., as defined above), for example, as compared to a control subject (e.g., the population median). A "resistant" subject is one in which the treatment will have no effect, will produce an effect less than that observed in a control subject (e.g., the population median), or will produce an effect only if the treatment is administered in an amount greater than would be applied to a control subject (e.g., the population median).

A "sensitivity biomarker" and "biomarker of sensitivity" to a target drug, as used herein, mean a gene or gene product for which the expression level (e.g., mRNA expression level or protein expression level) has been correlated to higher subject sensitivity to treatment with the target drug (e.g., 5-FU, irinotecan, oxaliplatin, or combinations thereof). In certain embodiments, an increased level of expression of the sensitivity biomarker in a biological sample obtained from a subject, relative to a control subject (e.g. the population median), indicates that the subject is sensitive to the treatment. For example, biomarkers of sensitivity to 5-FU include those listed in Table 1, biomarkers of sensitivity to irinotecan include those listed in Table 3, and biomarkers of sensitivity to oxaliplatin include those listed in Table 5.

A "resistance biomarker" and "biomarker of resistance" to a target drug, as used herein, mean a gene or gene product for which the expression level (e.g., mRNA expression level or protein expression level) has been correlated to reduced subject sensitivity to treatment with the target drug (e.g., 5-FU, irinotecan, oxaliplatin, or combinations thereof). In certain embodiments, an increased level expression of the resistance biomarker in a biological sample obtained from a subject, relative to a control subject (e.g. the population median), indicates that the subject is resistant to the treatment. For example, biomarkers of resistance to 5-FU include those listed in Table 2, biomarkers of resistance to irinotecan include those listed in Table 4, and biomarkers of resistance to oxaliplatin include those listed in Table 6. By "gene" is meant, e.g., a coding or noncoding gene whose activity can be determined by measuring the produced RNA. Examples include protein coding genes, microRNAs, small nuclear RNAs and other RNAs with catalytic, regulatory or coding properties.

"Compound" as used herein means a chemical or biological substance, e.g., a drug, a protein, an antibody, or an oligonucleotide, which may be used to treat a disease or which has biological activity in vivo or in vitro. Compounds may or may not be approved by the U.S. Food and Drug Administration (FDA). Compounds of the invention include, e.g., anti-cancer agents (e.g., chemotherapy agents) that may inhibit cancer growth. Anti-cancer agents (chemotherapy agents) include 5-FU, capecitabine, tegafur, irinotecan, oxaliplatin, fulvestrant (also known under the name FASLODEX®), gefitinib (IRESSA®), ERLOTINIB (TARCEVA®), tamoxifen, trastuzumab (HERCEPTIN®), cisplatin, belinostat, and vincristine.

By "target drug" is meant a drug or combination of drugs that can be used to treat a subject, e.g., a patient suffering from or susceptible to a disease, disorder, or condition of interest (e.g., a cancer, such as colon cancer). Different subjects may have varying responsiveness (e.g., sensitivity and/or resistance) to a target drug, which can be assessed according to the methods and/or using the devices of the invention. Exemplary target drugs include 5-FU, irinotecan, and oxaliplatin, as well as prodrugs, derivatives, metabolites, enantiomers, analogs, and combinations thereof.

By "biomarker" and "biomarker gene" is meant a gene (e.g., a protein-coding DNA, mRNA, microRNA, or noncoding RNA) in a cell, the expression of which correlates to responsiveness (e.g., sensitivity or resistance) of the cell (and thus the patient containing the cell or from which the cell was obtained) to a treatment (e.g., exposure to a compound of the invention).

The terms "expression level" and "level of expression," as used herein, refer to the amount of a gene product in a cell, tissue, biological sample, organism, or subject, e.g., amounts of DNA, RNA, or proteins, amounts of modifications of DNA, RNA, or protein, such as splicing, phosphorylation, acetylation, or methylation, or amounts of activity of DNA, RNA, or proteins associated with a given gene.

"Microarray" as used herein means a device employed by any method that quantifies one or more subject oligonucleotides, e.g., DNA or RNA, or analogs thereof, at a time. One exemplary class of microarrays consists of DNA probes attached to a glass or quartz surface. For example, many microarrays, including those made by Affymetrix, use several probes for determining the expression of a single gene. The DNA microarray may contain oligonucleotide probes that may be, e.g., full-length cDNAs complementary to an RNA or cDNA fragments that hybridize to part of an RNA. Exemplary RNAs include mRNA, miRNA, and miRNA precursors. Exemplary microarrays also include a "nucleic acid microarray" having a substrate-bound plurality of nucleic acids, hybridization to each of the plurality of bound nucleic acids being separately detectable. The substrate may be solid or porous, planar or non-planar, unitary or distributed. Exemplary nucleic acid microarrays include all of the devices so called in Schena (ed.), DNA Microarrays: A Practical Approach (Practical Approach Series), Oxford University Press (1999); Nature Genet. 21(1)(suppl.):1-60 (1999); Schena (ed.), Microarray Biochip: Tools and Technology, Eaton Publishing Company/BioTechniques Books Division (2000). Additionally, exemplary nucleic acid microarrays include substrate-bound plurality of nucleic acids in which the plurality of nucleic acids are disposed on a plurality of beads, rather than on a unitary planar substrate, as is described, inter alia, in Brenner et al., Proc. Natl. Acad. Sci. USA 97(4):1665-1670 (2000). Examples of nucleic acid microarrays may be found in U.S. Pat. Nos. 6,391,623, 6,383,754, 6,383,749, 6,380,377, 6,379,897, 6,376,191, 6,372,431, 6,351,712 6,344,316, 6,316,193, 6,312,906, 6,309,828, 6,309,824, 6,306,643, 6,300,063, 6,287,850, 6,284,497, 6,284,465, 6,280,954, 6,262,216, 6,251,601, 6,245,518, 6,263,287, 6,251,601, 6,238,866, 6,228,575, 6,214,587, 6,203,989, 6,171,797, 6,103,474, 6,083,726, 6,054,274, 6,040,138, 6,083,726, 6,004,755, 6,001,309, 5,958,342, 5,952,180, 5,936,731, 5,843,655, 5,814,454, 5,837,196, 5,436,327, 5,412,087, 5,405,783, the disclosures of which are incorporated herein by reference in their entireties. Exemplary microarrays may also include "peptide microarrays" or "protein microarrays" having a substrate-bound plurality of polypeptides, the binding of a oligonucleotide, a peptide, or a protein to each of the plurality of bound polypeptides being separately detectable. Alternatively, the peptide microarray, may have a plurality of binders, including but not limited to monoclonal antibodies, polyclonal antibodies, phage display binders, yeast 2 hybrid binders, aptamers, which can specifically detect the binding of specific oligonucleotides, peptides, or proteins. Examples of peptide arrays may be found in WO 02/31463, WO 02/25288, WO 01/94946, WO 01/88162, WO 01/68671, WO 01/57259, WO 00/61806, WO 00/54046, WO 00/47774, WO 99/40434, WO 99/39210, WO 97/42507 and U.S. Pat. Nos. 6,268,210, 5,766,960, 5,143,854, the disclosures of which are incorporated herein by reference in their entireties.

"Complement" of a nucleic acid sequence or a "complementary" nucleic acid sequence as used herein refers to an oligonucleotide which is in "antiparallel association" when it is aligned with the nucleic acid sequence such that the 5' end of one sequence is paired with the 3' end of the other. Nucleic acids are referred to as being "complementary" if they contain nucleotides or nucleotide homologues that can form hydrogen bonds according to Watson-Crick base-pairing rules (e.g., G with C, A with T or A with U) or other hydrogen bonding motifs such as for example diaminopurine with T, 5-methyl C with G, 2-thiothymidine with A, inosine with C, pseudoisocytosine with G, etc. Anti-sense RNA may be complementary to other oligonucleotides, e.g., mRNA. A complementary nucleic acid sequence may include non-naturally-occurring bases, e.g., inosine and 7-deazaguanine. When complementary nucleic acid sequences form a stable duplex, they are said to be "hybridized." "Complementarity" may not be perfect; stable duplexes of complementary nucleic acids may contain mismatched base pairs or unmatched bases. Those skilled in the art of nucleic acid technology can determine duplex stability empirically considering a number of variables including, for example, the length of the oligonucleotide, percent concentration of cytosine and guanine bases in the oligonucleotide, ionic strength, and incidence of mismatched base pairs.

To "inhibit growth" and "inhibition of growth," as used herein, mean causing a reduction in cell growth in vivo or in vitro by about, e.g., 10%, 20%, 30%, 40%, 50%, 60%, 70%, 80%, 90%, 95%, or 99% or more, as evident by a reduction in the size or number of cells exposed to a treatment (e.g., exposure to a compound), relative to the size or number of cells in the absence of the treatment. Growth inhibition may be the result of a treatment that induces apoptosis in a cell, induces necrosis in a cell, inhibits cell proliferation and/or cell cycle progression, disrupts cellular metabolism, induces cell lysis, or induces some other mechanism that reduces the size or number of cells.

By "NCI60" is meant a panel of 60 cancer cell lines from lung, colon, breast, ovarian, leukemia, renal, melanoma, prostate and brain cancers including the following cancer cell lines: NSCLC_NCIH23, NSCLC_NCIH522, NSCLC_A549ATCC, NSCLC_EKVX, NSCLC_NCIH226, NSCLC_NCIH332M, NSCLC_H460, NSCLC_HOP62, NSCLC_HOP92, COLON_HT29, COLON_HCC-2998, COLON_HCT116, COLON_SW620, COLON_COL0205, COLON_HCT15, COLON_KM12, BREAST_MCF7, BREAST_MCF7ADRr, BREAST_MDAMB231, BREAST_HS578T, BREAST_MDAMB435, BREAST_MDN, BREAST_BT549, BREAST_T47D, OVAR_OVCAR3, OVAR_OVCAR4, OVAR_OVCAR5, OVAR_OVCAR8, OVAR_IGROV1, OVAR_SKOV3, LEUK_CCRFCEM, LEUK_K562, LEUK_MOLT4, LEUK_HL60, LEUK_RPMI8266, LEUK_SR, RENAL_UO31, RENAL_SN12C, RENAL_A498, RENAL_CAKI1, RENAL_RXF393, RENAL_7860, RENAL_ACHN, RENAL_TK10, MELAN_LOXIMVI, MELAN_MALME3M, MELAN_SKMEL2, MELAN_SKMEL5, MELAN_SKMEL28, MELAN_M14, MELAN_UACC62, MELAN_UACC257, PROSTATE_PC3, PROSTATE_DU145, CNS_SNB19, CNS_SNB75, CNS_U251, CNS_SF268, CNS_SF295, and CNS_SF539.

The terms "biological sample" and "sample," as used herein, refer to any specimen (e.g., cells, tissue (e.g., a tissue sample obtained by biopsy, such as a tumor biopsy), blood, serum, plasma, urine, sputum, cerebrospinal fluid, lymph tissue or fluid, or pancreatic fluid) taken from a subject. In certain embodiments, the biological sample is taken from a portion of the body affected by a cancer (e.g., a biopsy). Biopsy (e.g., colorectal cancer biopsy, breast cancer biopsy, gastrointestinal malignancy biopsy, head and neck cancer biopsy, or ovarian cancer biopsy) may involve fine needle aspiration biopsy, core needle biopsy (e.g., stereotactic core needle biopsy, vacuum-assisted core biopsy, or magnetic resonance imaging (MRI) guided biopsy), or surgical biopsy (e.g., incisional biopsy or excisional biopsy). In certain embodiments, the biological sample is obtained from a tumor (e.g., a tumor biopsy). The sample may undergo additional purification and processing, for example, to remove cell debris and other unwanted molecules. Additional processing may further involve amplification, e.g., using PCR (RT-PCR). The standard methods of sample purification, such as removal of unwanted molecules, are known in the art.

The terms "effective amount," "amount effective to," and "therapeutically effective amount," as used interchangeably herein, refer to an amount of an anti-cancer agent (e.g., 5-FU, irinotecan, or oxaliplatin) sufficient to produce a desired result, such as complete response (CR) of the patient having a cancer, partial response (PR) of the patient having a cancer, or stable disease (SD) in the patient having a cancer. The desirable response criteria (CR, PR, or SD) are well-known in the art, see, e.g., Response Evaluation Criteria in Solid Tumors (RECIST).

The terms "patient" and "subject," as used interchangeably herein, refer to any animal (e.g., a mammal, e.g., a human). A subject to be treated or tested for responsiveness to an anti-cancer agent according to the methods described herein may be one who has been diagnosed with a cancer (e.g., colorectal cancer, breast cancer, gastrointestinal malignancy, head and neck cancer, or ovarian cancer). Diagnosis may be performed by any method or technique known in the art, such as self-exam, x-ray (e.g., mammogram), MRI, or biopsy. Non-limiting example of a subject include a human having colon cancer or rectal cancer, or a female (e.g., a postmenopausal female) having a breast cancer (e.g., a hormone receptor positive breast cancer). A subject may have been identified using techniques and methods known in the art. To minimize exposure of a subject to drugs that may not be useful, the subject may be determined as either responsive or non-responsive to a specific anti-cancer agent (e.g., 5-FU, irinotecan, or oxaliplatin) according to the methods of the invention. A "control" or "control subject" refers, for example, to a subject not suffering from or not susceptible to a disease, disorder, or condition treatable or diagnosable with the methods, devices, and/or kits described herein, or to a population median (e.g., a median level measured in a set of subjects not suffering from or not susceptible to a disease, disorder, or condition treatable or diagnosable with the methods, devices, and/or kits described herein).

"Treatment," "medical treatment," to "treat," and "therapy" mean administering or exposing a subject, a cell, or a tumor to, e.g., a compound, such as an anti-cancer agent (e.g., a drug, a protein, an antibody, a nucleic acid, a chemotherapeutic agent, or a radioactive agent), or to some other form of medical intervention used to treat or prevent a disease, disorder, or condition (e.g., surgery, cryotherapy, radiation therapy, or combinations thereof). In certain embodiments, the disease to be treated is cancer or symptoms of cancer. Radiation therapy includes the administration of a radioactive agent to a subject, or exposure of a subject to radiation. The radiation may be generated from sources such as particle accelerators and related medical devices or agents that emit, e.g., X-radiation, gamma radiation, or electron (Beta radiation) beams. A treatment may further include surgery, e.g., to remove a tumor from a subject or living organism.

The terms "cancer" and "cancerous" refer to or describe the physiological condition in mammals that is typically characterized by unregulated cell growth. Included in this definition are benign and malignant cancers. A cancer may include a solid or liquid tumor. By "early stage cancer" or "early stage tumor" is meant a cancer that is not invasive or metastatic or is classified as a Stage 0, I, or II cancer. Exemplary cancers include colorectal cancer (e.g., colon cancer and rectal cancer), leukemia (e.g., acute myeloid leukemia, acute lymphoid leukemia, chronic myeloid leukemia, chronic lymphocytic leukemia, acute myeloblastic leukemia, acute promyelocytic leukemia, acute myelomonocytic leukemia, acute monocytic leukemia, acute erythroleukemia, and chronic leukemia), myeloma (e.g., multiple myeloma), myelodysplastic syndrome, lymphoma (e.g., diffuse large B-cell lymphoma, cutaneous T-cell lymphoma, peripheral T-cell lymphoma, Hodgkin's lymphoma, non-Hodgkin's lymphoma, Waldenstrom's macroglobulinemia, and lymphocytic lymphoma), cervical cancer, prostate cancer, esophageal cancer, melanoma, glioma (e.g., oligodendroglioma), pancreatic cancer (e.g., adenosquamous carcinoma, signet ring cell carcinoma, hepatoid carcinoma, colloid carcinoma, islet cell carcinoma, and pancreatic neuroendocrine carcinoma), ovarian cancer (e.g., ovarian adenocarcinoma or embryonal carcinoma), gastrointestinal stromal tumor, sarcoma (e.g., fibrosarcoma, myxosarcoma, liposarcoma, chondrosarcoma, osteogenic sarcoma, angiosarcoma, endotheliosarcoma, lymphangiosarcoma, lymphangioendotheliosarcoma, leiomyosarcoma, Ewing's sarcoma, and rhabdomyosarcoma), breast cancer (e.g., medullary carcinoma), ER-positive cancer, bladder cancer, head and neck cancer (e.g., squamous cell carcinoma of the head and neck), lung cancer (e.g., non-small cell lung carcinoma, large cell carcinoma, bronchogenic carcinoma, and papillary adenocarcinoma), metastatic cancer, oral cavity cancer, uterine cancer, testicular cancer (e.g., seminoma and embryonal carcinoma), skin cancer (e.g., squamous cell carcinoma, and basal cell carcinoma), thyroid cancer (e.g., papillary carcinoma and medullary carcinoma), brain cancer (e.g., astrocytoma and craniopharyngioma), stomach cancer, intraepithelial cancer, bone cancer, biliary tract cancer, eye cancer, liver cancer (e.g., hepatocellular carcinoma or hepatoma), larynx cancer, kidney cancer (e.g., renal cell carcinoma and Wilms tumor), gastric cancer, blastoma (e.g., nephroblastoma, medulloblastoma, hemangioblastoma, neuroblastoma, and retinoblastoma), polycythemia vera, chordoma, synovioma, mesothelioma, adenocarcinoma, sweat gland carcinoma, sebaceous gland carcinoma, cystadenocarcinoma, bile duct carcinoma, choriocarcinoma, epithelial carcinoma, ependymoma, pinealoma, acoustic neuroma, schwannoma, meningioma, pituitary adenoma, nerve sheath tumor, cancer of the small intestine, cancer of the endocrine system, cancer of the penis, cancer of the urethra, cutaneous or intraocular melanoma, a gynecologic tumor, solid tumors of childhood, and neoplasms of the central nervous system.

DETAILED DESCRIPTION OF THE INVENTION

Figure 1:
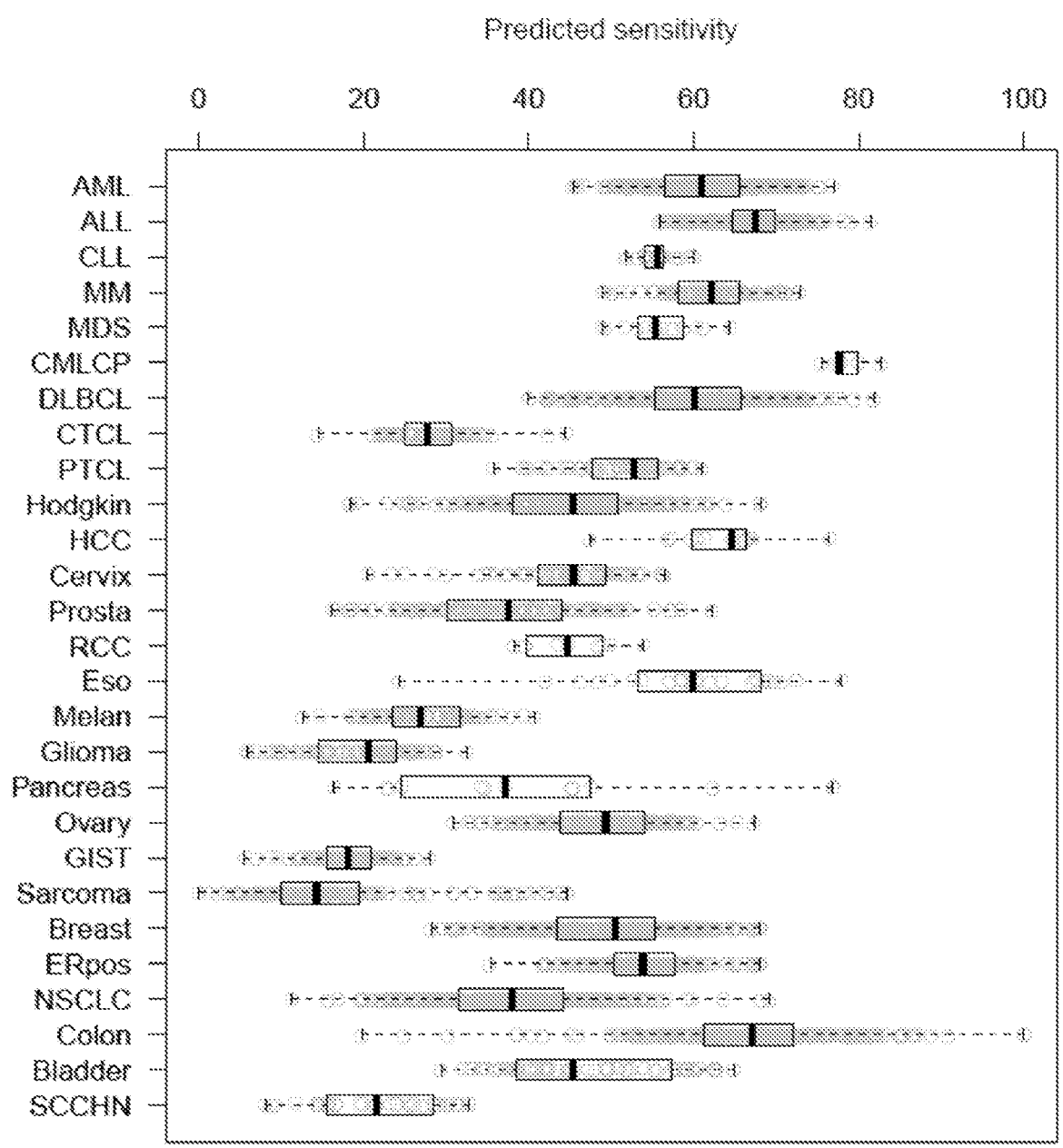
FIG. 1 is a graph grouping predicted sensitivity to 5-FU by indication. Each gray circle represents the predicted 5-FU sensitivity of one patient. Patients are grouped according to indication, and the relative mean predicted sensitivity (black cross) for an indication is related to the relative response rate for that indication. The predictions can only be used for relative comparisons: comparing indications to each other. It cannot be used for absolute predictions of response rate for a given indication. The predictions are normalized to a scale of 0-100 for all 3522 patients in this plot.

Drug response predictors are assays that, based on a biological sample from a subject, can predict whether the subject will respond to a specific drug or drug combination. The present invention provides drug response predictors and biomarkers useful for assessing the responsiveness of subjects to treatment with one or more specified target drugs of interest, e.g., 5-fluorouracil (5-FU), irinotecan, and/or oxaliplatin, as well as analogs thereof, such as prodrugs (e.g., capecitabine or tegafur), derivatives, metabolites, enantiomers, and combinations thereof. In particular, the invention provides methods useful in determining whether a subject is, e.g., sensitive or resistant to a target drug by, e.g., measuring the expression level (e.g., mRNA or protein expression level) of one or more biomarkers of sensitivity and/or resistance to the drug in a biological sample obtained from the subject. The expression levels of sensitivity biomarkers can then be compared to the expression of, for example, (i) other sensitivity biomarkers, (ii) resistance biomarkers, or (iii) biomarker expression levels in control subjects, to assess the subject's responsiveness to treatment with the target drug. Conversely, the expression levels of resistance biomarkers can be compared to the expression of, for example, (i) other resistance biomarkers, (ii) sensitivity biomarkers, or (iii) biomarker expression levels in control subjects, to assess the subject's responsiveness to treatment with the drug. In certain embodiments, the target drug includes 5-FU (or a prodrug thereof, e.g., capecitabine or tegafur), irinotecan, and/or oxaliplatin. Pre-clinical and clinical validation of drug response predictors have been developed by the present inventors for a number of other drugs (see, e.g., U.S. Pat. No. 8,445,198; PCT Publication No. WO2011/135459; PCT Publication No. WO2012163541; Chen et al., *Mol. Cancer Ther.* 11(1): 34-44, 2012; Bullinger et al., 2013, presented at ESMO conference 2012; Wang et al., *J. National Cancer Inst.* 105(17): 1284-91, 2013; Knudsen et al., *PLOS ONE,* 9(2): e87415, 2014; each of which is incorporated herein in its entirety).

The invention further features devices and kits for determining the expression level of such biomarkers, e.g., arrays of oligonucleotide probes suitable for hybridization to and detection of the biomarkers (e.g., biomarkers of sensitivity or resistance to, for example, 5-FU, irinotecan, and oxaliplatin). Also featured are methods of identifying biomarkers of sensitivity or resistance to a drug based on the correlation of biomarker expression to treatment efficacy, e.g., the growth inhibition of cancer cells. As such, the methods, devices, and kits described herein provide novel and effective means to, e.g., diagnose and/or monitor patient responsiveness to particular drug regimens of interest. Moreover, the methods, devices, and kits of the invention can be used to identify subject subpopulations that are responsive to a drug previously thought to be ineffective for treating disease (e.g., cancer, such as colorectal cancer) in the general population.

Methods of Diagnosis and Monitoring

The invention features diagnostic methods useful for assessing a subject's likely responsiveness to treatment with one or more target drugs (e.g., 5-FU, irinotecan, or oxaliplatin). Such methods can also be used to monitor a subject's responsiveness to such target drugs during or after treatment. In some embodiments, the subject is suffering from or at risk of developing a disease or condition (in particular, cancer, e.g., colorectal cancer), such as a disease or condition treatable with one or more target drugs, such as those described herein.

Indications

The methods, devices, and kits of the invention can be used for diagnosing, prognosing, monitoring, treating, and/or preventing cancer in a subject suffering from, diagnosed with, or susceptible to cancer. Non-limiting examples of cancers that can be diagnosed, prognosed, monitored, treated, or prevented using the present invention include colorectal cancer (e.g., colon cancer and rectal cancer), leukemia (e.g., acute myeloid leukemia, acute lymphoid leukemia, chronic myeloid leukemia, chronic lymphocytic leukemia, acute myeloblastic leukemia, acute promyelocytic leukemia, acute myelomonocytic leukemia, acute monocytic leukemia, acute erythroleukemia, and chronic leukemia), myeloma (e.g., multiple myeloma), myelodysplastic syndrome, lymphoma (e.g., diffuse large B-cell lymphoma, cutaneous T-cell lymphoma, peripheral T-cell lymphoma, Hodgkin's lymphoma, non-Hodgkin's lymphoma, Waldenstrom's macroglobulinemia, and lymphocytic lymphoma), cervical cancer, prostate cancer, esophageal cancer, melanoma, glioma (e.g., oligodendroglioma), pancreatic cancer (e.g., adenosquamous carcinoma, signet ring cell carcinoma, hepatoid carcinoma, colloid carcinoma, islet cell carcinoma, and pancreatic neuroendocrine carcinoma), ovarian cancer (e.g., ovarian adenocarcinoma or embryonal carcinoma), gastrointestinal stromal tumor, sarcoma (e.g., fibrosarcoma, myxosarcoma, liposarcoma, chondrosarcoma, osteogenic sarcoma, angiosarcoma, endotheliosarcoma, lymphangiosarcoma, lymphangioendotheliosarcoma, leiomyosarcoma, Ewing's sarcoma, and rhabdomyosarcoma), breast cancer (e.g., medullary carcinoma), ER-positive cancer, bladder cancer, head and neck cancer (e.g., squamous cell carcinoma of the head and neck), lung cancer (e.g., non-small cell lung carcinoma, large cell carcinoma, bronchogenic carcinoma, and papillary adenocarcinoma), metastatic cancer, oral cavity cancer, uterine cancer, testicular cancer (e.g., seminoma and embryonal carcinoma), skin cancer (e.g., squamous cell carcinoma, and basal cell carcinoma), thyroid cancer (e.g., papillary carcinoma and medullary carcinoma), brain cancer (e.g., astrocytoma and craniopharyngioma), stomach cancer, intra-epithelial cancer, bone cancer, biliary tract cancer, eye cancer, liver cancer (e.g., hepatocellular carcinoma or hepatoma), larynx cancer, kidney cancer (e.g., renal cell carcinoma and Wilms tumor), gastric cancer, blastoma (e.g., nephroblastoma, medulloblastoma, hemangioblastoma, neuroblastoma, and retinoblastoma), polycythemia vera, chordoma, synovioma, mesothelioma, adenocarcinoma, sweat gland carcinoma, sebaceous gland carcinoma, cystadenocarcinoma, bile duct carcinoma, choriocarcinoma, epithelial carcinoma, ependymoma, pinealoma, acoustic neuroma, schwannoma, meningioma, pituitary adenoma, nerve sheath tumor, cancer of the small intestine, cancer of the endocrine system, cancer of the penis, cancer of the urethra, cutaneous or intraocular melanoma, a gynecologic tumor, solid tumors of childhood, and neoplasms of the central nervous system.

In certain embodiments, the cancer is a colon cancer, such as colorectal cancer (e.g., adenocarcinoma, gastrointestinal carcinoid tumor, primary colorectal lymphoma, leiomyosarcoma, colorectal melanoma, and squamous cell carcinoma). The colon cancer can be, for example, a Stage 0, Stage I, Stage II, Stage III, or Stage IV colon cancer. In certain embodiments, the colon cancer is Stage II or Stage III colon cancer. In alternate embodiments, the cancer is a breast cancer, such as medullary carcinoma. The breast cancer can be, for example, a Stage 0, Stage I, Stage II, Stage III, or Stage IV breast cancer.

Target Drugs

The present invention features drug response predictors for drugs of interest ("target drugs"), in which the expression level of one or more of a panel of biomarkers is used to determine a subject's responsiveness (e.g., sensitivity or resistance) to a target drug. A target drug can be useful for treating or preventing a condition, disease, or disorder such as those described herein (e.g., colon cancer). In certain embodiments, the target drug is one previously thought to be ineffective for treating or preventing a condition, disease, or disorder, such as those described herein, in a patient or subpopulation of patients, but which may be effective in certain subject subpopulations (e.g., a subpopulation identifiable by the methods, devices, or kits of the invention). Exemplary target drugs include, but are not limited to, 5-fluorouracil (5-FU), irinotecan, and/or oxaliplatin, as well as analogs thereof, such as prodrugs, derivatives, metabolites, enantiomers, and combinations thereof.

Biomarkers of Drug Responsiveness

Particular subsets of a patient population may be sensitive or resistant to a particular target drug. The present invention provides a set of biomarker genes, the expression levels of which (e.g., as detected in biological samples obtained from a subject, such as a patient in need of treatment) are indicative of sensitivity or resistance to certain target drugs (e.g., 5-FU, irinotecan, or oxaliplatin). Such biomarkers can be identified using methods such as those the inventors have previously described in, e.g., Chen et al. (*Mol. Cancer Ther.* 11:34-33, 2012), Wang et al. (*J. Nat. Cancer Inst.* 105: 1284-1291, 2013), and Knudsen et al. (*PLoS One,* 9: e87415, 2014), each of which are incorporated by reference herein in their entirety. In certain embodiments, an algorithm based on growth inhibition values (GI50) of a cell line (e.g., NCI60 cells) is subjected to treatment with a target drug and gene expression is determined (e.g., by microarray analysis, next generation sequencing, or NanoString). After normalization, genes with, e.g., a Pearson correlation greater than 0.25 or below -0.25 can be classified as biomarkers of sensitivity or resistance, respectively.

Biomarkers of responsiveness identified as described above can be used to predict drug responsiveness in subjects, e.g., patients suffering from or susceptible to a disease, disorder, or condition (e.g., colon cancer) treatable with the drug, by measuring their expression level in a biological sample obtained from the subject. For example, the expression level of one or more biomarkers of 5-FU resistance, such as those shown in Table 2 (e.g., NT5E), or biomarkers of 5-FU sensitivity, such as those shown in Table 1, can be measured in a biological sample obtained from the subject, and the resultant measurement can be used to assess the subject's responsiveness to 5-FU treatment. The expression level of a biomarker can be measured in a biological sample, e.g., using a device or method of the present invention. For example, a microarray containing probes directed to one or more such biomarkers can be used to measure the mRNA expression level of the biomarkers. Each probe can have, e.g., at least 5, 10, 15, 20, or 25 or more contiguous nucleic acid residues (e.g., at least 10) that are complementary to a nucleic acid sequence of a selected biomarker; the probe sequence can be at least 85% (e.g., 90%, 95%, 99%, or 100%) identical to the sequence of the biomarker. In some embodiments, subjects showing elevated expression of a biomarker, e.g., relative to the population median, are predicted to be resistant to treatment with the drug, while subjects showing reduced expression of a biomarker, e.g., relative to the population median, are predicted to be sensitive to treatment with the drug. In one embodiment, subjects with an elevated level of NT5E expression relative to the population median are predicted to be resistant to treatment with 5-FU, while subjects with an NT5E expression level below the population median are predicted to be sensitive to 5-FU treatment. In some embodiments, subjects showing elevated expression of a biomarker, e.g., relative to the population median, are predicted to be sensitive to treatment with the drug, while subjects showing reduced expression of a biomarker, e.g., relative to the population median, are predicted to be resistant to treatment with the drug.

The expression level of multiple biomarkers (e.g., biomarkers of sensitivity and/or resistance to a target drug) in a biological sample (e.g., a biological sample obtained from a subject) can be compared to: (i) each other, (ii) a predetermined cutoff level (for example, the expression level in a control, a median expression level observed in a population of controls, or the median expression level in the overall population), or (iii) an expression level in patients that are sensitive and/or resistant to a target drug (e.g., 5-FU, irinotecan, and oxaliplatin). Such comparisons can be used to determine a subject's responsiveness to a target drug, such as 5-FU, irinotecan, and oxaliplatin. For example, the difference in expression level between a biomarker of sensitivity and a biomarker of resistance can be used to predict responsiveness (e.g., sensitivity or resistance) to the target drug.

In some embodiments, a minimum difference in expression level between a biomarker of sensitivity and a biomarker of resistance in the subject is required to classify a subject as responsive (e.g., sensitive and/or resistant) to a target drug. In alternate embodiments, a minimum difference in expression level of a biomarker of sensitivity and/or a biomarker of resistance between a subject and a control (e.g., a population median) is required to classify the subject as responsive (e.g., sensitive and/or resistant) to a target drug. In certain embodiments, the minimum difference is a statistically significant difference (e.g., as determined according to statistical methods well known in the art, such as a t-test). In various embodiments, the minimum difference is at least about 1%, 5%, 10%, 15%, 20%, 25%, 30%, 35%, 40%, 50%, 60%, 70%, 80%, 90%, or 100%.

In other embodiments, a maximum difference in expression level of a biomarker of sensitivity and/or a biomarker of resistance between a subject and the median expression level of the biomarker in a population that is sensitive or resistant, respectively, to the target drug, is required to classify the subject as sensitive or resistant, respectively, to the target drug. In certain embodiments, the maximum difference is a statistically significant difference (e.g., as determined according to statistical methods well known in the art, such as a t-test). In various embodiments, the maximum difference is at least about 1%, 5%, 10%, 15%, 20%, 25%, 30%, 35%, 40%, 50%, 60%, 70%, 80%, 90%, or 100%.

The following tables list biomarkers of responsiveness (sensitivity or resistance) to 5-FU, irinotecan, and oxaliplatin. Each AffyID probeset can match several genes or isoforms, and one gene can be matched by several probesets. Sequences for Almac probes to one or more of the biomarkers of sensitivity or resistance to 5-FU, irinotecan, or oxaliplatin, can also be found in the sequences listed in Tables 7-12, which list probesets, including Almac IDs and probe sequences, which can be used to detect the listed biomarkers.

5-FU

Biomarkers identified as indicative of sensitivity or resistance to 5-FU are shown in Tables 1 and 2, respectively, below.

TABLE 1

Genes predicting sensitivity to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| APRT | 203219_s_at | 0.442 | CTCTCCTGCAGTATGAGTGACCACA | SEQ ID NO. 1 |
| GSR | 205770_at | 0.408 | GCAATAGCTGCTGGCCGAAAACTTG | SEQ ID NO. 2 |
| TUFM | 201113_at | 0.407 | GAACATGGCCTGTCGGATTATCCTG | SEQ ID NO. 3 |
| MRPS2 | 218001_at | 0.402 | GTTACTTACTCAGCTGATGTCACAG | SEQ ID NO. 4 |
| MTHFD2 | 201761_at | 0.386 | GCTGTCCTTTTGAGGCTTAGTCAGT | SEQ ID NO. 5 |
| WDR59 | 218505_at | 0.378 | AAGTGCCGGTGACAAGCTGTCTGTC | SEQ ID NO. 6 |
| ANP32B | 201305_x_at | 0.374 | GACTGCTCATGGATTTTGTAGCTGT | SEQ ID NO. 7 |
| PMM2 | 203201_at | 0.366 | AGGAAACGGTTCATGTGTCACTTTT | SEQ ID NO. 8 |
| STOML2 | 215416_s_at | 0.366 | GGACCCGAGAGTCGGCCATCAATGT | SEQ ID NO. 9 |
| NDUFAB1 | 202077_at | 0.364 | GAATAAAGTATCAGACCCTTTGGCT | SEQ ID NO. 10 |
| ANP32A | 201051_at | 0.361 | TTTGGAGTTCTCTTACGTTTCCTGG | SEQ ID NO. 11 |
| IL27RA | 222062_at | 0.361 | GAATGACTGCATGGATAGAACCACT | SEQ ID NO. 12 |
| MIR3658 UCK2 | 209825_s_at | 0.359 | GTCAGGAGGCACTGCTCATCTGTAC | SEQ ID NO. 13 |
| USH1C | 211184_s_at | 0.358 | ACACACACCAGATGGCATCCTTGGG | SEQ ID NO. 14 |
| APRT | 213892_s_at | 0.351 | TGCGTGCTCATCCGAAAGCGGGGGA | SEQ ID NO. 15 |
| SERPINB1 | 212268_at | 0.347 | ACAGCAGGCATCGCAACTTTCTGCA | SEQ ID NO. 16 |
| RUVBL1 | 201614_s_at | 0.345 | GGACCATGCTGTATACTCCACAGGA | SEQ ID NO. 17 |
| HSPD1 | 200806_s_at | 0.341 | GAAGCTCTAAGTACACTCGTCTTGA | SEQ ID NO. 18 |
| RBM47 | 218035_s_at | 0.338 | CTACTGAGGCCTTTAAGCACCGCTA | SEQ ID NO. 19 |
| KBTBD11 | 204301_at | 0.336 | GTGAGATCAAAGCTCCTCCAAAGCC | SEQ ID NO. 20 |
| GCLC | 202923_s_at | 0.335 | TACTCTGGAGCAACCTACTGTCTAA | SEQ ID NO. 21 |
| S100A14 | 218677_at | 0.335 | CATGTGGGGAGAGGACCAGCTGGGT | SEQ ID NO. 22 |
| HMGB1 | 200679_x_at | 0.333 | CAAAGGAGAACATCCTGGCCTGTCC | SEQ ID NO. 23 |
| MYC | 202431_s_at | 0.326 | GCTAAAACGGAGCTTTTTTGCCCTG | SEQ ID NO. 24 |
| HSD17B7 | 220081_x_at | 0.325 | TCAGGCCAGGCTCAGTGGCTCATGC | SEQ ID NO. 25 |
| FABP5 | 202345_s_at | 0.324 | AATGAGCAAATCTCCATACTGTTTC | SEQ ID NO. 26 |
| PRIM1 | 205053_at | 0.323 | GACAAATATGGACCCTGGCTGGAGT | SEQ ID NO. 27 |
| HSPE1 | 205133_s_at | 0.323 | GTCGCTGTTGGATCGGGTTCTAAAG | SEQ ID NO. 28 |
| MRPS35 | 217942_at | 0.323 | TTTCCCCACAAGCTGGCATTTCAGT | SEQ ID NO. 29 |
| SLC19A1 | 211576_s_at | 0.32 | GCTGGGAAGTACGTCCCAGCGGCC | SEQ ID NO. 30 |
| PGD | 201118_at | 0.319 | TAAGGCAGGCAGCCACCGAGTTTGG | SEQ ID NO. 31 |
| LGALS4 | 204272_at | 0.319 | CGCTGTGGCTTGGATCGCTTCAAGG | SEQ ID NO. 32 |
| PRR13 | 217794_at | 0.319 | CCCAGCAGGCCTTTTGTTGGTTGCA | SEQ ID NO. 33 |
| EEF1B2 SNORA41 | 200705_s_at | 0.316 | GTCTGGGGCTCATCTAAACTAGTTC | SEQ ID NO. 34 |
| GTF2E1 | 205930_at | 0.314 | GAACTTTCACACAAGGGTCTGTAAC | SEQ ID NO. 35 |

TABLE 1-continued

Genes predicting sensitivity to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| INSIG1 | 201625_s_at | 0.313 | GATGACTTACCCTGAAGTCTTCCCT | SEQ ID NO. 36 |
| ZFP36 | 201531_at | 0.311 | ATATATTGGGTCGTCTGCTTCCCTT | SEQ ID NO. 37 |
| SLC9A3R1 | 201349_at | 0.31 | GGAAGGTGAATGTGTTCCCGTCCTC | SEQ ID NO. 38 |
| PTGES2 | 218083_at | 0.309 | GCGCCTGGCGATACTGGTTGGGGGC | SEQ ID NO. 39 |
| RNPS1 | 200060_s_at | 0.308 | GGTGGTCTTTCAGGTTATCTTGGCA | SEQ ID NO. 40 |
| GCNT3 | 219508_at | 0.307 | AACCATCACCTGTTGGCCAACAAGT | SEQ ID NO. 41 |
| CALML4 | 221879_at | 0.307 | CGACCTGCGGTCAAAACTCACGAGT | SEQ ID NO. 42 |
| DDC | 205311_at | 0.306 | AATAAATATCATCCTGCCTTCATGG | SEQ ID NO. 43 |
| INSIG1 | 201627_s_at | 0.305 | AACCAATCTGAGCCTTGTATCTCTT | SEQ ID NO. 44 |
| USH1C | 205137_x_at | 0.305 | TGACGATGAGCTGACCTTCTTGCTG | SEQ ID NO. 45 |
| GPX2 | 202831_at | 0.304 | CAAGACTTGGGTAAGCTCTGGGCCT | SEQ ID NO. 46 |
| GCN1L1 | 216232_s_at | 0.304 | TAAGAACACCGTGGTCAGGGCCTAC | SEQ ID NO. 47 |
| AGMAT | 221648_s_at | 0.304 | GTACCCTCTATGACTGTAATTCCTG | SEQ ID NO. 48 |
| TSPAN8 | 203824_at | 0.303 | GGTTTGGTGTTTTCTATGGTCCTGT | SEQ ID NO. 49 |
| GCSH | 213129_s_at | 0.303 | AATGCCCTTTAACTTTCTAATGATT | SEQ ID NO. 50 |
| RPL3 | 215963_x_at | 0.302 | GATTGGCCAGGGCTACCTTATCAAG | SEQ ID NO. 51 |
| CYBA | 203028_s_at | 0.3 | ACTTTGGTGCCTACTCCATTGTGGC | SEQ ID NO. 52 |
| PPRC1 | 203737_s_at | 0.297 | GTTCTGCAAGAGGAGCTATTCTGAT | SEQ ID NO. 53 |
| HRSP12 | 203790_s_at | 0.297 | AAAGCTGCAGGCTGTGACTTCACTA | SEQ ID NO. 54 |
| FASN | 212218_s_at | 0.296 | ACACCAGAGCTGCCGACTTGGAGAC | SEQ ID NO. 55 |
| CALML4 | 64408_s_at | 0.294 | CACCCTTCCTGGACGGGACTATTGA | SEQ ID NO. 56 |
| CLDN3 | 203954_x_at | 0.293 | AGAAGAAGTACACGGCCACCAAGGT | SEQ ID NO. 57 |
| RPL13A SNORD32A SNORD33 SNORD34 SNORD35A | 200715_x_at | 0.29 | TCCTCCATTGTTGCCCTGGAATGTA | SEQ ID NO. 58 |
| SEL1L3 | 212314_at | 0.29 | GTAGTCTTCTCCATGAATTACACGT | SEQ ID NO. 59 |
| MRPL16 | 217980_s_at | 0.289 | CTGTGAGCCGCGGGACTCTAGAGAA | SEQ ID NO. 60 |
| MUC13 | 218687_s_at | 0.289 | GGAGTAAGAGCCTTAGGTCAGTTTG | SEQ ID NO. 61 |
| RPL13 SNORD68 | 212933_x_at | 0.288 | AAGCACTGTTGGTTGTTTGGTTAGT | SEQ ID NO. 62 |
| TPT1 | 216520_s_at | 0.288 | GACTCGCTCATTGGTGGAAATGCCT | SEQ ID NO. 63 |
| TXN | 208864_s_at | 0.287 | CAGATCGAGAGCAAGACTGCTTTTC | SEQ ID NO. 64 |
| TPK1 | 221218_s_at | 0.286 | TGGCCCGCGTGATTGTGGCATTTAA | SEQ ID NO. 65 |
| TMPO | 203432_at | 0.285 | AGTAATTTTATTTGTTGTCTTCTGA | SEQ ID NO. 66 |
| HSP90AB1 | 214359_s_at | 0.284 | ATCTCTGTCAGAGTATGTTTCTCGC | SEQ ID NO. 67 |
| SHMT2 | 214437_s_at | 0.284 | CCTTAACTTCTCGACAGTTCCGTGA | SEQ ID NO. 68 |

TABLE 1-continued

Genes predicting sensitivity to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| SEL1L3 | 212311_at | 0.283 | GGAAGGTACGATAATCCCACACCAT | SEQ ID NO. 69 |
| ANK3 | 206385_s_at | 0.281 | TTACTGTATTGTGTACTGGCTATAA | SEQ ID NO. 70 |
| ALG5 | 218203_at | 0.281 | GACCTACTTTTTATACGACTTCGAT | SEQ ID NO. 71 |
| HMGB1 | 200680_x_at | 0.28 | CCTGTCCATTGGTGATGTTGCGAAG | SEQ ID NO. 72 |
| CCT3 | 200910_at | 0.28 | GGTGAGACGGGTACTTTGGTGGACA | SEQ ID NO. 73 |
| TSR3 | 213105_s_at | 0.279 | AAAATCTAGAGACATGAGGGACATA | SEQ ID NO. 74 |
| ANP32B | 201306_s_at | 0.275 | GTAGCGTGGATAGCTGTGATTGGTG | SEQ ID NO. 75 |
| ETS2 | 201329_s_at | 0.273 | GGTTCTGGCTGTTTGAGATTCTCAA | SEQ ID NO. 76 |
| ATIC | 208758_at | 0.273 | TCAGTCTAACTCTGTGTGCTACGCC | SEQ ID NO. 77 |
| RPL13 SNORD68 | 212191_x_at | 0.273 | GACCATCGGCATTTCTGTGGATCCG | SEQ ID NO. 78 |
| FBXL14 | 213145_at | 0.271 | AAAAGGTCACACAGTGCGGCTTCCT | SEQ ID NO. 79 |
| LPCAT4 | 40472_at | 0.268 | TGGCCAATGGGACTGTGCAAGCACC | SEQ ID NO. 80 |
| NUP37 | 218622_at | 0.267 | AAGTGTTTTCTGTACCTTAGATTCA | SEQ ID NO. 81 |
| WBSCR22 | 207628_s_at | 0.266 | GTGTTCACCAATGAGAGGTTCCCAT | SEQ ID NO. 82 |
| PDSS1 | 220865_s_at | 0.266 | GGTGTGCAACAAACAACCTACCTCG | SEQ ID NO. 83 |
| SLX1A-SULT1A3 SLX1B-SULT1A4 SULT1A3 SULT1A4 | 209607_x_at | 0.265 | TGAGCGCTTCGATGCGGACTATGCG | SEQ ID NO. 84 |
| GTF3A | 215091_s_at | 0.265 | TATGTCGCTGTCCAAGAGAAGGCTG | SEQ ID NO. 85 |
| ATHL1 | 219359_at | 0.265 | CAGGTGTGCATGGGTCCAAGGCCCT | SEQ ID NO. 86 |
| MIR4680 PDCD4 | 212593_s_at | 0.264 | TTTTGTAAGTGCCATGTTTATTATC | SEQ ID NO. 87 |
| CNOT1 | 200860_s_at | 0.263 | TGCTGTACCTTTTTGCAGAGGCCAA | SEQ ID NO. 88 |
| DUSP2 | 204794_at | 0.263 | CTCAGCTGACATTTAACACTTCCTC | SEQ ID NO. 89 |
| EPCAM | 201839_s_at | 0.262 | ACTTGGACTCCATCGTTAAAATTAT | SEQ ID NO. 90 |
| CASP7 | 207181_s_at | 0.261 | GAAATGGATGTAAGCCTGGCCCATA | SEQ ID NO. 91 |
| RPL13 SNORD68 | 208929_x_at | 0.26 | AGCTGACCGGACCGGTCATGCCCGT | SEQ ID NO. 92 |
| RPL13 SNORD68 | 214351_x_at | 0.258 | TGAAGGAGTACCGCTCCAAACTCAT | SEQ ID NO. 93 |

TABLE 2

Genes predicting resistance to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| NT5E | 203939_at | −0.478 | GTCACTGTAAATCATTCTTAAGCCC | SEQ ID NO. 94 |
| CNN3 | 201445_at | −0.474 | GAGCTCAGTATTTAGTCCTTTGTTT | SEQ ID NO. 95 |
| ACTN1 | 208637_x_at | −0.44 | CTTCCTTCAAGATCCTGGCTGGGGA | SEQ ID NO. 96 |
| FLNA | 200859_x_at | −0.422 | GAGGGAGCCATTTGGTGGCGCTGCT | SEQ ID NO. 97 |
| ATP2B4 | 212135_s_at | −0.42 | CACCTTTCATATCTAGGGACCACCC | SEQ ID NO. 98 |
| CYR61 | 210764_s_at | −0.417 | TTGTGAGGTGCGGCCTTGTGGACAG | SEQ ID NO. 99 |
| ACTN1 | 208636_at | −0.414 | AAATCCCCTCAGAGGTGTGACTAGT | SEQ ID NO. 100 |
| LGALS1 | 201105_at | −0.411 | ATCATGGCTTGTGGTCTGGTCGCCA | SEQ ID NO. 101 |
| RHOC | 200885_at | −0.41 | GGCCCCTGGAGTTGTTTCTGCAGGG | SEQ ID NO. 102 |
| RAB32 | 204214_s_at | −0.41 | GGCTTTGCCGGATGGTTTGAAACCT | SEQ ID NO. 103 |
| TMEM158 | 213338_at | −0.409 | CACCGATATATTGTTACCGCTGAAA | SEQ ID NO. 104 |
| CYR61 | 201289_at | −0.404 | GCTTTTATTCGTCCTTTGACAAAAG | SEQ ID NO. 105 |
| FLNA | 214752_x_at | −0.4 | AATGGGGGACGAGCACATCCCAGG | SEQ ID NO. 106 |
| SNAPC1 | 205443_at | −0.398 | GGTCAAGGGCAAGTCAAAGCAACTA | SEQ ID NO. 107 |
| CCND1 | 208712_at | −0.396 | CCCGGTCATCTAGCAAGCTGCCGAA | SEQ ID NO. 108 |
| FLNA | 213746_s_at | −0.396 | AAAGCAGGCAACAACATGCTGCTGG | SEQ ID NO. 109 |
| FYN | 210105_s_at | −0.384 | CCTATGTGATTTTAACTCTGTCTTC | SEQ ID NO. 110 |
| TRAM2 | 202369_s_at | −0.376 | GCACTCTAGAGCTACTTGTTCACGT | SEQ ID NO. 111 |
| DNAJB6 | 209015_s_at | −0.37 | GTTGAACTCATGTTTCAGTTCGCGA | SEQ ID NO. 112 |
| CD44 | 212063_at | −0.37 | TACTTTGACTTTTCAGAGCACACCC | SEQ ID NO. 113 |
| PEA15 | 200787_s_at | −0.369 | CACCCACCTGTACTCTGGAGAGACT | SEQ ID NO. 114 |
| F3 | 204363_at | −0.369 | AAAGCTTCTATGGTTGACATTGTAT | SEQ ID NO. 115 |
| GRB10 | 209409_at | −0.366 | TTCTCTTTTCTGCACTTAATACCTG | SEQ ID NO. 116 |
| CD59 | 200985_s_at | −0.363 | GGTAGGATATCTTGGCTTTGCCACA | SEQ ID NO. 117 |
| PRNP | 201300_s_at | −0.363 | AGGTCTTTGAAATATGCATGTACTT | SEQ ID NO. 118 |

TABLE 2-continued

Genes predicting resistance to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| LOC100506032 NBPF10 NBPF11 NBPF12 NBPF15 NBPF16 NBPF24 NBPF7 NBPF8 NBPF9 | 201103_x_at | −0.361 | GAGGACAGGTCAGCTGTCTGGCTCA | SEQ ID NO. 119 |
| VIM | 201426_s_at | −0.359 | GCAGTCCCTCACCTGTGAAGTGGAT | SEQ ID NO. 120 |
| CD44 | 204489_s_at | −0.357 | TTGAATGGGTCCATTTTGCCCTTCC | SEQ ID NO. 121 |
| DKK1 | 204602_at | −0.356 | GAGTCTAGAACGCAAGGATCTCTTG | SEQ ID NO. 122 |
| MARCKS | 201670_s_at | −0.353 | TGCATACTTTGCATCTTTATTCAAA | SEQ ID NO. 123 |
| PPAP2B | 212226_s_at | −0.352 | GCACCATCCCAGTGATGTTCTGGCA | SEQ ID NO. 124 |
| IL6ST | 212195_at | −0.351 | GATGGGTCGTGTGATGAGATGCATT | SEQ ID NO. 125 |
| CAV1 | 212097_at | −0.35 | CAGAAAGCTGCCTGGTATATCCAAA | SEQ ID NO. 126 |
| PURA | 204020_at | −0.346 | AGGATTTCCATGTAGCTGTGGTGCT | SEQ ID NO. 127 |
| STK17A | 202693_s_at | −0.345 | GTTACTTCATATACTCTAGGACAAT | SEQ ID NO. 128 |
| LOX | 204298_s_at | −0.344 | GTTGTGCGCTGTGACATTCGCTACA | SEQ ID NO. 129 |
| NR3C1 | 201865_x_at | −0.337 | GAACTACGCTTGCTCATTTTTTCTT | SEQ ID NO. 130 |
| PPAP2B | 212230_at | −0.336 | GATTATAAACTGTGTCTCGACCTGT | SEQ ID NO. 131 |
| MARCKS | 201669_s_at | −0.333 | CGATCATAGTCTTAGGAGTTCATTT | SEQ ID NO. 132 |
| LOC100506032 NBPF10 NBPF11 NBPF12 NBPF15 NBPF16 NBPF24 NBPF7 NBPF8 NBPF9 | 213612_x_at | −0.332 | TTTACTGTGCCTTTGTTTTTACTAG | SEQ ID NO. 133 |
| FAM50A | 203262_s_at | −0.329 | GCGCTCGAGATCCTTCGGAAAGACT | SEQ ID NO. 134 |
| CAV1 | 203065_s_at | −0.326 | ATCTGGGGCATTTACTTCGCCATTC | SEQ ID NO. 135 |
| QKI | 212636_at | −0.322 | GTATTTGCAGAGTATTAGCTTTGAA | SEQ ID NO. 136 |
| IL6ST | 212196_at | −0.321 | GTACACCTGCCCTAAGGAGAAAATA | SEQ ID NO. 137 |

TABLE 2-continued

Genes predicting resistance to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| LEPRE1 | 220750_s_at | -0.321 | GAGTCTCTCTCAGGCAGTGAATCGA | SEQ ID NO. 138 |
| EMP3 | 203729_at | -0.317 | GAGGGGGCAGCTTCGGATACTGCTT | SEQ ID NO. 139 |
| GRB10 | 210999_s_at | -0.316 | AACGACGATTTGCTGCTGTGAACCC | SEQ ID NO. 140 |
| ZNHIT6 | 218932_at | -0.315 | TATGTAACTTACCCTTGTGAGACAA | SEQ ID NO. 141 |
| CALU | 200757_s_at | -0.31 | GGTATAATGTAACTTCACCCCAGCC | SEQ ID NO. 142 |
| PTPRK | 203038_at | -0.31 | ATGCTCCACGTAGCTGTAACTTCAC | SEQ ID NO. 143 |
| PSMD2 | 200830_at | -0.309 | GGCCACTGAGGAGTTTCTTCCTGTT | SEQ ID NO. 144 |
| PCMT1 | 205202_at | -0.309 | AACATGCTGTGTAAGCTGTGTCCTA | SEQ ID NO. 145 |
| CD59 | 200983_x_at | -0.306 | AAAACAGTTCTTCTGCTGGTGACTC | SEQ ID NO. 146 |
| THY1 | 208850_s_at | -0.305 | CCTCGGCAGGCATGGCTGGTGCCTG | SEQ ID NO. 147 |
| CD44 | 210916_s_at | -0.303 | GAGTCGTCAGAAACTCCAGACCAGT | SEQ ID NO. 148 |
| TRIB2 | 202478_at | -0.302 | GTTCGGATTTGACTGCCTGTATATG | SEQ ID NO. 149 |
| NR3C1 | 211671_s_at | -0.301 | GGACGTAATCTCCACAGTCAAAGAA | SEQ ID NO. 150 |
| FTSJ1 | 205324_s_at | -0.3 | TGAGTTGTTCACCTTAACCCATTAC | SEQ ID NO. 151 |
| CALU | 200755_s_at | -0.298 | GAACCTGCCATTACCTGGGCAAGGA | SEQ ID NO. 152 |
| KIF2C | 209408_at | -0.296 | AGGAGCTCTTAGTTACCCTTTTGTG | SEQ ID NO. 153 |
| LEPROT | 202378_s_at | -0.295 | GATAACGCTGAAGCAGGCCTCTCAT | SEQ ID NO. 154 |
| AAK1 | 205434_s_at | -0.295 | CCGCTGCGCGATTGACACGCATATT | SEQ ID NO. 155 |
| MAP7D1 | 217943_s_at | -0.295 | CCTTGGATCCGGGCACAGTTGTGAG | SEQ ID NO. 156 |
| C19orf10 | 221739_at | -0.294 | ATCGCAGATCCGGGGCACAAAGAGG | SEQ ID NO. 157 |
| CENPF | 207828_s_at | -0.292 | TACCCCTGGGAGGTGCCAGTCATTG | SEQ ID NO. 158 |
| CAPN2 | 208683_at | -0.29 | AATCGTTCTCCTTACAATCAAGTTC | SEQ ID NO. 159 |
| CD44 | 209835_x_at | -0.288 | AGCAAACACAACCTCTGGTCCTATA | SEQ ID NO. 160 |
| ATM | 210858_x_at | -0.287 | TGCTCATACAGCAGGCCATAGACCC | SEQ ID NO. 161 |

TABLE 2-continued

Genes predicting resistance to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| MXRA7 | 212509_s_at | −0.286 | GAGCTATCTAGGTTTGTCTGGAAAG | SEQ ID NO. 162 |
| THY1 | 213869_x_at | −0.286 | CCCTAACGAGACACATTTGCCCAAA | SEQ ID NO. 163 |
| FHL2 | 202949_s_at | −0.285 | CTCACCCAGGCAATCTTGCCTTCTG | SEQ ID NO. 164 |
| RND3 | 212724_at | −0.285 | GCAGCCAAGGTCTGTGTTCAGCACT | SEQ ID NO. 165 |
| AXL | 202686_s_at | −0.283 | GTTGGACACCTTTAGGTTCTTTGCT | SEQ ID NO. 166 |
| LOXL2 | 202998_s_at | −0.281 | GACAGGTTGTCATCAGCTTGTCCCA | SEQ ID NO. 167 |
| CTNNAL1 | 202468_s_at | −0.28 | GATCCATGATGGCTCTCTTAGTCCA | SEQ ID NO. 168 |
| CD44 | 204490_s_at | −0.28 | GGACACCCCAAATTCCAGAATGGCT | SEQ ID NO. 169 |
| TFE3 | 212457_at | −0.28 | GCCAGGCCCCATGGAGGGTATACTG | SEQ ID NO. 170 |
| SPTAN1 | 215235_at | −0.28 | ATCATCATGTCACTGTGGGGACCCA | SEQ ID NO. 171 |
| LIMA1 | 217892_s_at | −0.28 | AGAACTGTCTTACACCACTTGAGCT | SEQ ID NO. 172 |
| MSN | 200600_at | −0.279 | TTATTATTACTGTTTGTCTTCTCCC | SEQ ID NO. 173 |
| NR2F2 | 209121_x_at | −0.279 | GTTTGTTTGCTTAATTTCCTTCTGT | SEQ ID NO. 174 |
| PTPLA | 219654_at | −0.279 | AGAGAGTGTGGTGCTTTTTCTGGTC | SEQ ID NO. 175 |
| FHL1 | 201540_at | −0.278 | GGATCACCTACTTACTGTATTCTAC | SEQ ID NO. 176 |
| C20orf3 | 206656_s_at | −0.278 | ATAACGTGCGGTCATACCTTTCTTC | SEQ ID NO. 177 |
| OXSR1 | 202696_at | −0.276 | GAGATTCCTCCTTATGATGTATGCT | SEQ ID NO. 178 |
| TIMP2 | 203167_at | −0.276 | GAACCACAGGTACCAGATGGGCTGC | SEQ ID NO. 179 |
| OSBPL3 | 209626_s_at | −0.276 | ATAACATTAGTGTATTTCTCCTGTG | SEQ ID NO. 180 |
| ZNF331 | 219228_at | −0.276 | TTCATTTATGGATCGAGCCTCGTGA | SEQ ID NO. 181 |
| SEPT7 | 213151_s_at | −0.275 | GAAATGGGAATCATGGCCTCTTGAA | SEQ ID NO. 182 |
| JUN | 201466_s_at | −0.274 | ATCTATATGGAATTGCTTACCAAAG | SEQ ID NO. 183 |
| IFRD1 | 202146_at | −0.274 | GCTGTATGAGACTTTGTGCATTTTA | SEQ ID NO. 184 |
| CDH11 | 207173_x_at | −0.273 | TTTCGCCTTAAACTCTGGACACTCT | SEQ ID NO. 185 |

TABLE 2-continued

Genes predicting resistance to 5-FU ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| USP33 | 214843_s_at | -0.273 | TGAAGACCTGGTTTTGATGCTGCCT | SEQ ID NO. 186 |
| LPP | 202822_at | -0.272 | ACTGATGTAACCTCAAAGCCTCTCA | SEQ ID NO. 187 |
| LHFPL2 | 212658_at | -0.27 | TTTAAGGGCTAATCTCACACCTCCT | SEQ ID NO. 188 |
| PURA | 204021_s_at | -0.269 | GGCGTGTTTATGCGAGTGAGCGAGG | SEQ ID NO. 189 |
| FKBP9 | 212169_at | -0.269 | TCAACAGAGTATTTCCCTTGGCCGA | SEQ ID NO. 190 |
| SOGA2 | 213358_at | -0.269 | AATTTGCACTGTTACATTTTGGTTC | SEQ ID NO. 191 |
| TUBB | 211714_x_at | -0.268 | CAAGCGCATCTCGGAGCAGTTCACT | SEQ ID NO. 192 |
| PTRF | 208789_at | -0.267 | TGATTCTGTTCGGACTGGGTTCTCA | SEQ ID NO. 193 |
| PMP22 | 210139_s_at | -0.267 | AACTGCTTTTGTACCTAGCTAGGCT | SEQ ID NO. 194 |
| RAB31 | 217762_s_at | -0.267 | AGGACATTAGGATTGGTGCTCAGAA | SEQ ID NO. 195 |
| RAB31 | 217763_s_at | -0.267 | GAGTGAGCACACTGGCTTTGCATCC | SEQ ID NO. 196 |
| MAP4K4 | 206571_s_at | -0.266 | GGAATTCCTTGTAACTGGAGCTCGG | SEQ ID NO. 197 |
| CRIM1 | 202552_s_at | -0.264 | GGTAATTAATCCATTCCTGGCATAA | SEQ ID NO. 198 |
| SVIL | 202565_s_at | -0.264 | GCATTAGGTATGACTTGTTCTGAGT | SEQ ID NO. 199 |
| ROBO1 | 213194_at | -0.261 | GTTGTGGCCAATGTCGAAACCTACA | SEQ ID NO. 200 |
| EMC3 | 217882_at | -0.261 | AGACCTCCACTTCGAAGGCATGTTC | SEQ ID NO. 201 |
| ULK2 | 204062_s_at | -0.26 | GTGGAGTTCCTACATGCAGTGAGTG | SEQ ID NO. 202 |
| SCRN1 | 201462_at | -0.259 | TCATGTGCACATGCCGTTGCAGCAC | SEQ ID NO. 203 |
| RAB31 | 217764_s_at | -0.258 | TAAAGAGCTTCCATCTGGGCTGGAC | SEQ ID NO. 204 |
| FOXN3 | 218031_s_at | -0.258 | ACCGATGTGTCTATGGTGCTGCACC | SEQ ID NO. 205 |
| RPF1 | 218462_at | -0.258 | AACGGGATTACATATTCTTCAGATT | SEQ ID NO. 206 |
| EBNA1BP2 | 201323_at | -0.254 | GCCTCAAGAGGCCTGGCAAGAAAGG | SEQ ID NO. 207 |
| ATM | 212672_at | -0.254 | AGAATCTGGGGTTTGCCAGTCAGTT | SEQ ID NO. 208 |

In some aspects of the invention, one or more biomarkers of sensitivity and/or resistance to 5-FU are measured in a biological sample obtained from a subject (e.g., a subject suffering from or susceptible to a disease, disorder, or condition treatable with 5-FU, such as cancer, e.g., colon cancer) using, e.g., a microarray, sequencing, NanoString, a protein array, or PCR-based methods, such as those described herein. In certain embodiments, the microarray includes probes capable of recognizing the one or more biomarkers of sensitivity and/or resistance to 5-FU, such as probes at least about 15 nt in length that have, e.g., a sequence with at least 5 (e.g., at least 10) contiguous nucleotides that are complementary to or identical to the sequence(s) of the biomarker(s). In some embodiments of any of the above aspects, any one of the biomarkers from Tables 1 and 2 can be used to assess a subject's sensitivity and/or resistance to treatment with 5-FU. Alternatively, a combination of any of the biomarkers of Tables 1 and 2 may be used. For example, combinations that include the top 5, 10, 15, or 20 biomarkers from Tables 1 and/or 2 may be used. In some embodiments, one or more biomarkers of resistance to 5-FU is selected from the group consisting of NT5E, CNN3, ACTN1, FLNA, ATP2B4, CYR61, LGALS1, RHOC, RAB32, and TMEM158, and/or one or more biomarkers of sensitivity to 5-FU is selected from the group consisting of APRT, GSR, TUFM, MRPS2, MTHFD2, WDR59, ANP32B, PMM2, STOML2, and NDUFAB1. In certain embodiments, the one or more biomarkers of resistance to 5-FU include NT5E, CNN3, ACTN1, FLNA, and/or ATP2B4, and/or the biomarkers of sensitivity to 5-FU include GSR, TUFM, MRPS2, and/or MTHFD2. In particular embodiments, one or more biomarkers of resistance includes NT5E.

Furthermore, a combination of any of the biomarkers of Tables 1-4 can be used to assess a subject's sensitivity and/or resistance to treatment with the combination of 5-FU and irinotecan, and a combination of any of the biomarkers of Tables 1, 2, 5, and 6 can be used to assess a subject's sensitivity and/or resistance to treatment with the combination of 5-FU and oxaliplatin.

Irinotecan

Biomarkers identified as indicative of sensitivity or resistance to irinotecan are shown in Tables 3 and 4, below.

TABLE 3

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
| --- | --- | --- | --- | --- |
| PRF1 | 214617_at | 0.552 | GAGGTGGCTGGGTTTACACGCTAAT | SEQ ID NO. 209 |
| GZMB | 210164_at | 0.527 | TGCGAATCTGACTTACGCCATTATT | SEQ ID NO. 210 |
| PTPRC | 207238_s_at | 0.479 | GAAGGTTCTGAACCCACGAGTGGCA | SEQ ID NO. 211 |
| PTPRC | 212587_s_at | 0.464 | TGGCTGAATTTCAGAGCATCCCGCG | SEQ ID NO. 212 |
| PTPRCAP | 204960_at | 0.462 | AGCAATGTGGAGAGGCGTCCAGCCC | SEQ ID NO. 213 |
| LOC728802 PDE4DIP | 213388_at | 0.46 | CCTCTTTCTCAATCTATAACCTTTG | SEQ ID NO. 214 |
| ACAP1 | 205213_at | 0.459 | CCCTGCTACGACTGGCAAAGATGAG | SEQ ID NO. 215 |
| PTPRC | 212588_at | 0.459 | ATTGCATATGCATAGTTCCCATGTT | SEQ ID NO. 216 |
| S1PR1 | 204642_at | 0.456 | ACTTTAAGTCCAGCTATTCATTAG | SEQ ID NO. 217 |
| DOCK2 | 213160_at | 0.42 | GATTCCTGAACTCAAGGTACCAGCA | SEQ ID NO. 218 |
| ARHGEF6 | 209539_at | 0.416 | TAACCATGCTTACACACTAAACTAT | SEQ ID NO. 219 |
| CD3D | 213539_at | 0.415 | GGAATGACCAGGTCTATCAGCCCCT | SEQ ID NO. 220 |
| CYTIP | 209606_at | 0.414 | GTTGTGTTATAGTTTATGCTTCTTA | SEQ ID NO. 221 |
| ATF3 | 202672_s_at | 0.412 | CTCTCCACTCAATGTCTTAGGTCAG | SEQ ID NO. 222 |

TABLE 3-continued

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| SERPINA1 | 202833_s_at | 0.412 | GCATGTTTAACATCCAGCACTGTAA | SEQ ID NO. 223 |
| FAM129A | 217967_s_at | 0.408 | GGTAATCTTCTATGTCAGAGCTAGT | SEQ ID NO. 224 |
| HSD17B7 | 220081_x_at | 0.408 | TGCATACCTTCTGTACATTCTGGGG | SEQ ID NO. 225 |
| HCLS1 | 202957_at | 0.405 | GAACATTTCTCTTGTGTTCCTGACT | SEQ ID NO. 226 |
| CD247 | 210031_at | 0.4 | TGATTCACTTCACGCTTTCAGCGAA | SEQ ID NO. 227 |
| KBTBD11 | 204301_at | 0.396 | AGTGGCCACATCATTTCCACGTTTT | SEQ ID NO. 228 |
| LOC728802 PDE4DIP | 214129_at | 0.395 | GAAAGATCCTTGTCTGATTTTGGCA | SEQ ID NO. 229 |
| FAM129A | 217966_s_at | 0.393 | TACTCATCCTGCTATCAATTTCTTA | SEQ ID NO. 230 |
| PHF11 | 221816_s_at | 0.393 | ATCACTCTTTGCACACTCTTGTGTT | SEQ ID NO. 231 |
| PNMA2 | 209598_at | 0.389 | GGATTTTCACGATGTTCCTGTCTGC | SEQ ID NO. 232 |
| DDX23 | 201440_at | 0.387 | CCAAGGGGTGCTGTATGCTCTAGGC | SEQ ID NO. 233 |
| TRIM14 | 203148_s_at | 0.387 | AGGGTTACTGATCACTTACCTTCTT | SEQ ID NO. 234 |
| CD53 | 203416_at | 0.385 | TCTAAATAATGCCCAGTCTTCTCCC | SEQ ID NO. 235 |
| ITGA4 | 213416_at | 0.382 | GTACTATGGTTGTCCAACACAGGCC | SEQ ID NO. 236 |
| NFIL3 | 203574_at | 0.378 | GATAGTCCATGCGAAGGCTGTATAT | SEQ ID NO. 237 |
| ZAP70 | 214032_at | 0.377 | ATCACCAGAATAAACCCAGCTTCCC | SEQ ID NO. 238 |
| IL6R | 205945_at | 0.376 | AATATCCAATATTCGCTGTGTCAGC | SEQ ID NO. 239 |
| IFI16 | 208965_s_at | 0.373 | GGTTAAGTCCTTACTGAGCAACGAT | SEQ ID NO. 240 |
| PTPRE | 221840_at | 0.371 | GACACCTGTGTTTCAGCATTGGAG | SEQ ID NO. 241 |
| RAC2 | 213603_s_at | 0.369 | GCCAGTCAGGACTTTTGCTATTGCA | SEQ ID NO. 242 |
| PSMB9 | 204279_at | 0.368 | GTGGACCATCGAGTCATCTTGGGCA | SEQ ID NO. 243 |
| PSMD11 | 208776_at | 0.368 | GCTGTCCAATATGTAGCCGCTAGCC | SEQ ID NO. 244 |
| CCDC109B | 218802_at | 0.367 | AGGATTATACTTACTCAGCTGTTAA | SEQ ID NO. 245 |
| GOS2 | 213524_s_at | 0.366 | GCCTGACTCCGCTGGGAGAGTGCAG | SEQ ID NO. 246 |

TABLE 3-continued

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| RFTN1 | 212646_at | 0.365 | GCTGATTGTCTTGACCAAACCCACA | SEQ ID NO. 247 |
| PTPN7 | 204852_s_at | 0.362 | GACAGCTGCCTTGATACCAGCTCTC | SEQ ID NO. 248 |
| SERPINA1 | 211429_s_at | 0.362 | ACCTATGATCTGAAGAGCGTCCTGG | SEQ ID NO. 249 |
| ADD2 | 205268_s_at | 0.358 | TAAATGCCAACACTGTCTTCTCATG | SEQ ID NO. 250 |
| KIAA0226L | 44790_s_at | 0.357 | TTCACTGATGCTGAGCCAGTTTGTA | SEQ ID NO. 251 |
| PSMB8 | 209040_s_at | 0.356 | GTCATGGACAGTGGCTATCGGCCTA | SEQ ID NO. 252 |
| CD93 | 202878_s_at | 0.355 | TCAGCAGATTTTGCCCACTATTCCT | SEQ ID NO. 253 |
| N4BP2L1 | 213375_s_at | 0.353 | ACATGTGTAATTAGTCGGCAGCTCA | SEQ ID NO. 254 |
| TPK1 | 221218_s_at | 0.353 | TCTGTGTGCCCTGAAAATGTTACCA | SEQ ID NO. 255 |
| SELPLG | 209879_at | 0.348 | TCCATCTAGTGACAAGTGACCCCCA | SEQ ID NO. 256 |
| WDR59 | 218505_at | 0.348 | GCTGATGGACAGTGGCCTTCTAAAA | SEQ ID NO. 257 |
| NARF | 219862_s_at | 0.348 | CGGAGAGGTGGTGTTACGCTTTGCT | SEQ ID NO. 258 |
| PPRC1 | 203737_s_at | 0.347 | GACACATTGTTGAAACAGGCCCAGA | SEQ ID NO. 259 |
| HNRNPA1 | 222040_at | 0.346 | ATTCCCAGTAGTGACAGTGGATATA | SEQ ID NO. 260 |
| SEC31B | 209889_at | 0.345 | GCCTCTGACTTGGTATTTCCAGGTC | SEQ ID NO. 261 |
| IKZF1 | 205038_at | 0.344 | CCCATATCCCTTCTGTAATTTGTAC | SEQ ID NO. 262 |
| IL27RA | 222062_at | 0.341 | CATATGCCAACACGGGGTCTGGGTG | SEQ ID NO. 263 |
| STAT3 | 208991_at | 0.339 | ACATACTCCTGGCATTGCACTTTTT | SEQ ID NO. 264 |
| BATF | 205965_at | 0.337 | ATGCTCAAGTCCCATGGCACAGAGC | SEQ ID NO. 265 |
| ARHGAP15 | 218870_at | 0.337 | GCCTTTCAAGCGACAGATGCCTCAT | SEQ ID NO. 266 |
| SLA | 203761_at | 0.336 | TAAGCATTCCGTCCATCTAAGCTCA | SEQ ID NO. 267 |
| LAT | 211005_at | 0.33 | GTGCGAGTCTGAGTCAGAGATTTGG | SEQ ID NO. 268 |
| MIR3658 UCK2 | 209825_s_at | 0.328 | TGATGTGATCATCCCTAGAGGTGCA | SEQ ID NO. 269 |
| NAP1L1 | 208752_x_at | 0.327 | GATGAACCTATTCTGAAGCACTTGA | SEQ ID NO. 270 |

TABLE 3-continued

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| CBFB | 202370_s_at | 0.326 | AGAGCTCCTTGGTTTTTTACTTCTG | SEQ ID NO. 271 |
| TM6SF1 | 219892_at | 0.325 | AAATATTACTTCATGTTCCTCCTTT | SEQ ID NO. 272 |
| FMNL1 | 204789_at | 0.324 | TCAAGGAAGGTGGTCCTCAGCTCGG | SEQ ID NO. 273 |
| INSIG1 | 201626_at | 0.321 | GAACAAAATTTGCACTCTACCAGAT | SEQ ID NO. 274 |
| IFI16 | 208966_x_at | 0.32 | GAAACTTCACCAGACTTTTTCTTCT | SEQ ID NO. 275 |
| PRKCQ | 210038_at | 0.315 | CCATTCTCAGCAGACTCCAGTATTG | SEQ ID NO. 276 |
| FSCN1 LOC100653350 | 210933_s_at | 0.315 | GACTCCACAGGCAAATACTGGACGG | SEQ ID NO. 277 |
| TRIM22 | 213293_s_at | 0.315 | GACTATATCTAATTCCTCTGATCAC | SEQ ID NO. 278 |
| TACC3 | 218308_at | 0.315 | GACCAACTTACCACAGATCTGAACT | SEQ ID NO. 279 |
| SLC35G2 | 219569_s_at | 0.314 | CCTTGGACAAATTCCATCCAGCTTT | SEQ ID NO. 280 |
| TAF1A | 206613_s_at | 0.313 | GTGAGAAAGCTTTTGTGGCTGGTTT | SEQ ID NO. 281 |
| RHOH | 204951_at | 0.312 | CACAACACTTATGTATGCACCCCAA | SEQ ID NO. 282 |
| NAP1L1 | 212967_x_at | 0.311 | GGGTTGTACAGGGTGCCAGATAGAT | SEQ ID NO. 283 |
| JUNB | 201473_at | 0.308 | CTGCTGGAAACAGACTCGATTCATA | SEQ ID NO. 284 |
| PTPN2 | 213137_s_at | 0.308 | GTGCTCTACGGAAACGTATTCGAGA | SEQ ID NO. 285 |
| MCL1 | 200797_s_at | 0.307 | GCTGTACTTTTGATAGCTGTGCCAG | SEQ ID NO. 286 |
| GNA15 | 205349_at | 0.307 | CAGACCGCTGGAAAACACTGTCACT | SEQ ID NO. 287 |
| EIF4A1 | 214805_at | 0.307 | CTTTTTCCTGGGTCATGCTGCAACA | SEQ ID NO. 288 |
| CXorf57 | 219355_at | 0.306 | TATTCTTGCTGTACTCATTGGTAGT | SEQ ID NO. 289 |
| SAMSN1 | 220330_s_at | 0.305 | TGGACACATTTTATCCTGATCCACA | SEQ ID NO. 290 |
| INSIG1 | 201627_s_at | 0.302 | AGACCATACCAGACCTAATTTGCAA | SEQ ID NO. 291 |
| HNRNPR | 208765_s_at | 0.302 | ACCCTCCAGATTACTACGGCTATGA | SEQ ID NO. 292 |
| FAM216A | 204521_at | 0.301 | TGGAGAGAGAGGACTCGGGGTCTTC | SEQ ID NO. 293 |
| SRSF7 | 213649_at | 0.298 | AGATCTACTAGACCATGGGCCAAAG | SEQ ID NO. 294 |

TABLE 3-continued

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| MFNG | 204153_s_at | 0.295 | GCCTTTCTTGCTGTTAGGGGCTACC | SEQ ID NO. 295 |
| GPR183 | 205419_at | 0.295 | GCAGGACTTCCCTTATAAAGCAAAA | SEQ ID NO. 296 |
| BCAT1 | 214452_at | 0.295 | GATTTCTTTGGCTACCTGTGCATAA | SEQ ID NO. 297 |
| PLAGL1 | 209318_x_at | 0.293 | AATAACTTTATGTGGCACTGCCTAG | SEQ ID NO. 298 |
| BIRC3 | 210538_s_at | 0.293 | CAGGGACACATTTCTCTGTCTTTTT | SEQ ID NO. 299 |
| CUTC | 218970_s_at | 0.293 | ACAGAATTCCACTGTTCTGCTCGGT | SEQ ID NO. 300 |
| UBE2L6 | 201649_at | 0.292 | GTTTGCAGTTACAGGCCAGTTCTCC | SEQ ID NO. 301 |
| SLA | 203760_s_at | 0.292 | GTCTGGGTTTGCAGATGGGTGCCCT | SEQ ID NO. 302 |
| CYTH4 | 219183_s_at | 0.292 | TCTGTCACCTCATTGGTCCATGAAG | SEQ ID NO. 303 |
| FAN1 | 203678_at | 0.291 | GAGCCAACATCACGTTTTGTTAGCT | SEQ ID NO. 304 |
| ANP32B | 201305_x_at | 0.29 | GACTGCTCATGGATTTTGTAGCTGT | SEQ ID NO. 305 |
| GMFG | 204220_at | 0.288 | AGCTGAGGAAATTCCGCTTCCGAAA | SEQ ID NO. 306 |
| LOC100288366 TUBA1B | 213646_x_at | 0.288 | AAATGTGACCCTCGCCATGGTAAAT | SEQ ID NO. 307 |
| — | 222315_at | 0.288 | CTGCACCATTCAAACTAGCCAACCC | SEQ ID NO. 308 |
| SLC19A1 | 211576_s_at | 0.287 | GGCCTCAGGGTCTAAGGAGCGCTAG | SEQ ID NO. 309 |
| PMAIP1 | 204286_s_at | 0.285 | AGGCAGCTATTTTACCATCTGGTAT | SEQ ID NO. 310 |
| EIF1 | 212225_at | 0.285 | TAGGCCTAATTCGTTTTCCTTTGTG | SEQ ID NO. 311 |
| TRBC1 | 211796_s_at | 0.284 | CCGAGGCCTGGGGTAGAGCAGACTG | SEQ ID NO. 312 |
| LARS2 | 34764_at | 0.284 | CCCCTGCAGTTCAGCAGTTAACAGA | SEQ ID NO. 313 |
| SRRT | 222047_s_at | 0.282 | GTATGGTGCTGGTCGAGGGAACTAT | SEQ ID NO. 314 |
| CTCF | 202521_at | 0.281 | GATTCTTGCACATGAACTGTCACAT | SEQ ID NO. 315 |
| ITK | 211339_s_at | 0.281 | CATGTGACGTTTTGACTGGCTTGAG | SEQ ID NO. 316 |
| AKAP2 PALM2-AKAP2 | 202759_s_at | 0.28 | GCCGTATATAGATCAATGTCCACAT | SEQ ID NO. 317 |
| TAP1 | 202307_s_at | 0.279 | TGGTGGAGCAGGCTGACCACATCCT | SEQ ID NO. 318 |

TABLE 3-continued

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| TIAM1 | 213135_at | 0.279 | CTCCAGTGCAACACATCCATCTGAA | SEQ ID NO. 319 |
| CD99 | 201028_s_at | 0.278 | TGGAGAAAATGACGACCCACGACCA | SEQ ID NO. 320 |
| CSDA | 201161_s_at | 0.277 | ACTGATAGGCAGTTCTCTGGGGCCC | SEQ ID NO. 321 |
| IL4R | 203233_at | 0.277 | CCACCAGATCATGGCCCACGTGGAG | SEQ ID NO. 322 |
| C1orf114 | 206721_at | 0.277 | AAACAGAGATCCACAACAAGCTTTT | SEQ ID NO. 323 |
| SLC16A3 | 202855_s_at | 0.276 | TGTTCGTGGTGAGCTACGCCAAGGA | SEQ ID NO. 324 |
| USP7 | 201498_at | 0.275 | GAGGGCATGCTCACTAGTGGTTAGT | SEQ ID NO. 325 |
| PAPD7 | 202466_at | 0.275 | GTAGGCCTGTACTAATCTCTACGCA | SEQ ID NO. 326 |
| RFX5 | 202963_at | 0.275 | TGGCAGCATCTTGTCATACGTGTCA | SEQ ID NO. 327 |
| MAP4K1 | 214219_x_at | 0.274 | CCAGCAACCTCTACATCCAGGAATG | SEQ ID NO. 328 |
| WHSC1 | 209053_s_at | 0.272 | GATTCCTCGAAACTGCCATTGTGAT | SEQ ID NO. 329 |
| CYFIP2 | 215785_s_at | 0.271 | ATGGCCGACCGGATCAGGAAGTATC | SEQ ID NO. 330 |
| FHOD1 | 218530_at | 0.271 | GGTGTGAAGGTGCTGTATCCCGGAA | SEQ ID NO. 331 |
| TGFB1 | 203085_s_at | 0.269 | TGGATCCACGAGCCCAAGGGCTACC | SEQ ID NO. 332 |
| LARP4B | 208954_s_at | 0.267 | AGTGAGTGTCTTGACATTTTCACCC | SEQ ID NO. 333 |
| SP110 | 209762_x_at | 0.267 | GAGGCTCACCTTAGAGCTTCTGAGT | SEQ ID NO. 334 |
| DPY19L1 | 212792_at | 0.266 | GGTAGCAGGTTCCATAGGCGTACAA | SEQ ID NO. 335 |
| CSDA | 201160_s_at | 0.265 | GATGCTGGTGCTAAACCTCCAAGTG | SEQ ID NO. 336 |
| ANP32E | 221505_at | 0.265 | TAATGCTCTTTGTATGGCAGTATGT | SEQ ID NO. 337 |
| FLI1 | 204236_at | 0.264 | TGACCTCGGTCACAAAAGCAGTTTT | SEQ ID NO. 338 |
| ARHGAP19 | 212738_at | 0.263 | GCTAATGCCGAGATCTTCTACCAGC | SEQ ID NO. 339 |
| POM121 POM121C | 213360_s_at | 0.263 | CCTTATGTAAGGTAGACCCTCCTAG | SEQ ID NO. 340 |
| LOC100506390 RAP1B | 200833_s_at | 0.262 | GATTGTGTGTCTATCCAACAGGGAG | SEQ ID NO. 341 |
| PSMB10 | 202659_at | 0.262 | CCACGTGGGTGCATCGCTGATCGTG | SEQ ID NO. 342 |

TABLE 3-continued

Genes predicting sensitivity to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| RHOG | 203175_at | 0.262 | TCCAGCTTTCCACACAGTTGTTGCT | SEQ ID NO. 343 |
| FNBP1 | 212288_at | 0.262 | GAGTTGCCTGTTTGTCTCTGGAGAT | SEQ ID NO. 344 |
| KIAA0226L | 219471_at | 0.262 | CCCGGTGTGCGAGGATCACAGCGAG | SEQ ID NO. 345 |
| DNAJC2 | 213097_s_at | 0.261 | ATAGCAGAAGCGGTGCCTGGCAGGA | SEQ ID NO. 346 |
| ANP32B | 201306_s_at | 0.259 | CTTCCATGTAGTCCCTCTTGGTAAT | SEQ ID NO. 347 |
| TRIP13 | 204033_at | 0.259 | ATAGGTCAGTTACTGGTCTCTTTCT | SEQ ID NO. 348 |
| SP140 | 207777_s_at | 0.259 | GGGAAGGATGTTGGCAGCGACACCA | SEQ ID NO. 349 |
| PRPF3 | 202251_at | 0.258 | GACCTTGCGCTGAGTGAATCTGTGT | SEQ ID NO. 350 |
| ICOS | 210439_at | 0.257 | CAGGTGTTCCCTGAGTTGTTTGCAG | SEQ ID NO. 351 |
| CORO1A | 209083_at | 0.256 | TATCTCTCCATGTTCAGTTCCAAGG | SEQ ID NO. 352 |
| TRBC1 | 210915_x_at | 0.255 | AAAGGCCACACTGGTGTGCCTGGCC | SEQ ID NO. 353 |

TABLE 4

Genes predicting resistance to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| CCND1 | 208712_at | −0.406 | ATCTCAATGAAGCCAGCTCACAGTG | SEQ ID NO. 354 |
| LGALS3 | 208949_s_at | −0.404 | TGATTGTGCCTTATAACCTGCCTTT | SEQ ID NO. 355 |
| INPP4B | 205376_at | −0.38 | GAATGGTATTCGTTTCACCTGTTGT | SEQ ID NO. 356 |
| TMEM97 | 212281_s_at | −0.344 | TACAGCCAGGCATAACATATCCACT | SEQ ID NO. 357 |
| TCF7L2 | 212761_at | −0.332 | GTTTTATGCTCTTATTCCAAGTTCA | SEQ ID NO. 358 |
| SFN | 33323_r_at | −0.33 | GCATGTCTGCTGGGTGTGACCATGT | SEQ ID NO. 359 |
| LAPTM4B | 214039_s_at | −0.327 | CCAAGTATGTCTAGTCACCTTTTAA | SEQ ID NO. 360 |
| LSR | 208190_s_at | −0.323 | GTCGTCTGATCTGACGTTTTCTACG | SEQ ID NO. 361 |

TABLE 4-continued

Genes predicting resistance to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| SFN | 209260_at | −0.323 | CCTGCTGCCTCTGATCGTAGGAATT | SEQ ID NO. 362 |
| TMEM97 | 212282_at | −0.317 | GTCTAGCATCTCAAGGCTGATCTGG | SEQ ID NO. 363 |
| SFN | 33322_i_at | −0.313 | ATGTCTGCTGGGTGTGACCATGTTT | SEQ ID NO. 364 |
| C19orf21 | 212925_at | −0.303 | TGAAATGGGACCCCTGCTGATTCTT | SEQ ID NO. 365 |
| SERPINB6 | 211474_s_at | −0.302 | AGGCAGACTTCTCTGGAATGTCCCA | SEQ ID NO. 366 |
| NR2F2 | 209120_at | −0.3 | AGACACATGCTGAGGTTTTGAATAA | SEQ ID NO. 367 |
| CTBP2 | 210835_s_at | −0.299 | ATTGAAGACAGTACAGGCTGCTGTA | SEQ ID NO. 368 |
| LAPTM4B | 208767_s_at | −0.298 | TCTGTTCCCTCTCTTTTGAAAATGT | SEQ ID NO. 369 |
| SQLE | 209218_at | −0.297 | TCTCCTAACCCTCTAGTTTTAATTG | SEQ ID NO. 370 |
| SORL1 | 203509_at | −0.292 | GAATATCACAGCTTACCTTGGGAAT | SEQ ID NO. 371 |
| GPX4 | 201106_at | −0.29 | ATCTGCGTGAACGGGACGACGCCC | SEQ ID NO. 372 |
| JUP | 201015_s_at | −0.286 | TCTCTGGGTCTGATTTTCTCACTGA | SEQ ID NO. 373 |
| LAPTM4B | 208029_s_at | −0.286 | AAGACCATTAGAAAGCACCAGGCCG | SEQ ID NO. 374 |
| ACTN1 | 208636_at | −0.279 | ATATTCCATCCTTTTTACTGATTTT | SEQ ID NO. 375 |
| CPNE3 | 202119_s_at | −0.277 | AAATTACCCATATTGACTTTCACAC | SEQ ID NO. 376 |
| TJP1 | 202011_at | −0.274 | ATGCGTGCATACCACTTTTGTTCTT | SEQ ID NO. 377 |
| KRT18 | 201596_x_at | −0.272 | GAGCTGCTGAGACGACGCTCACAGA | SEQ ID NO. 378 |
| KDELR3 | 204017_at | −0.271 | GATACCTGCCTTGTACTTAGTACCT | SEQ ID NO. 379 |
| DSG2 | 217901_at | −0.27 | AAGTTGGTCTTAAGCTTCCACCTTG | SEQ ID NO. 380 |
| LRP5 | 209468_at | −0.268 | GAAAGTCCATGATGAGCTCCGTGAG | SEQ ID NO. 381 |
| SUV420H1 | 218242_s_at | −0.268 | TCCCTTCACTTATCAGCATACTATT | SEQ ID NO. 382 |
| CTBP2 | 201220_x_at | −0.267 | ATAGAGCTTTTCCTTTATCAGTCC | SEQ ID NO. 383 |
| RRBP1 | 201204_s_at | −0.266 | AGAGCCCCAGTTTGTAAATGAACCT | SEQ ID NO. 384 |

TABLE 4-continued

Genes predicting resistance to irinotecan ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| EPCAM | 201839_s_at | −0.266 | ACTTGGACTCCATCGTTAAAATTAT | SEQ ID NO. 385 |
| LAD1 | 203287_at | −0.266 | GCTGTGGATCTGTTTGGCCAGGGTC | SEQ ID NO. 386 |
| PPAP2B | 212226_s_at | −0.266 | GAAATCCTTTCACCTGTGGACATTA | SEQ ID NO. 387 |
| SORL1 | 212560_at | −0.266 | ATCGTCACAGCCAAGTAATAACCCA | SEQ ID NO. 388 |
| LITAF | 200704_at | −0.265 | GACCTTCAAGGGTCCTCGTTTTGAT | SEQ ID NO. 389 |
| ACTN1 | 208637_x_at | −0.265 | CCCTGCCCGCGAAGTGACAGTTTAC | SEQ ID NO. 390 |
| APOBEC3B | 206632_s_at | −0.263 | AGCAATGTGCTCCTGATCAAGTAGA | SEQ ID NO. 391 |
| LITAF | 200706_s_at | −0.262 | TTCTCTGTGCCAGATCTTCAGTGCC | SEQ ID NO. 392 |
| ASAH1 | 213702_x_at | −0.262 | CAAGACCGTTTGTCCACTTCATTTT | SEQ ID NO. 393 |
| MLPH | 218211_s_at | −0.262 | TTCACTCTTGGCTTTCTTATGTTGC | SEQ ID NO. 394 |
| LAMB1 | 201505_at | −0.261 | ATAGCACATGCTTGTAACAGAGGAG | SEQ ID NO. 395 |
| TGFBR3 | 204731_at | −0.26 | GAATAGTGTCACCAATTCCACCAAG | SEQ ID NO. 396 |
| TMEM97 | 212279_at | −0.259 | ATACTCTCCACATTTCTGTTTGAGG | SEQ ID NO. 397 |
| SLC25A1 | 210010_s_at | −0.256 | TCATGTTCTGTGTCACGTGACCCTG | SEQ ID NO. 398 |

In some aspects of the invention, one or more biomarkers of sensitivity and/or resistance to irinotecan are measured in a biological sample obtained from a subject (e.g., a subject suffering from or susceptible to a disease, disorder, or condition treatable with irinotecan, such as cancer, e.g., colon cancer) using, e.g., a microarray, sequencing, NanoString, a protein array, or PCR-based methods, such as those described herein. In certain embodiments, the microarray includes probes capable of recognizing the one or more biomarkers of sensitivity and/or resistance to irinotecan, such as probes at least about 15 nt in length that have, e.g., a sequence with at least 5 (e.g., at least 10) contiguous nucleotides that are complementary to or identical to the sequence(s) of the biomarker(s). In embodiments of any of the above aspects, any one of the biomarkers from Tables 3 and 4 can be used to assess a subject's sensitivity and/or resistance to treatment with irinotecan. Alternatively, a combination of any of the biomarkers of Tables 3 and 4 may be used. For example, combinations that include the top 5, 10, 15, or 20 biomarkers from Tables 3 and/or 4 may be used. In some embodiments, one or more biomarkers of sensitivity to irinotecan is selected from the group consisting of PRF1, GZMB, PTPRC, PTPRC, PTPRCAP, PDE4DIP, ACAP1, PTPRC, S1PR1, and DOCK2, and/or one or more biomarkers of resistance to irinotecan are selected from the group consisting of CCND1, LGALS3, INPP4B, TMEM97, TCF7L2, SFN, LAPTM4B, LSR, SFN, and TMEM97. In certain embodiments, the one or more biomarkers of sensitivity include PRF1, GZMB, PTPRC, PTPRC, and/or PTPRCAP, and the one or more biomarkers of resistance include CCND1, LGALS3, INPP4B, TMEM97, and/or TCF7L2. In particular embodiments, one or more biomarkers of sensitivity include PRF1.

Furthermore, a combination of any of the biomarkers of Tables 1-4 can be used to assess a subject's sensitivity and/or resistance to treatment with the combination of 5-FU and irinotecan, and a combination of any of the biomarkers of Tables 3-6 can be used to assess a subject's sensitivity and/or resistance to treatment with the combination of irinotecan and oxaliplatin.

Oxaliplatin

Biomarkers identified as indicative of sensitivity and resistance to oxaliplatin are shown in Tables 5 and 6, below.

TABLE 5

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| MRPL16 | 217980_s_at | 0.444 | ACGTGACACCTGTGAAGGCTGGCCG | SEQ ID NO. 399 |
| ANP32A | 201051_at | 0.432 | TCACATGATGATACCTGCTTTTCTC | SEQ ID NO. 400 |
| SRSF2 | 214882_s_at | 0.428 | AGAGTCCTTGGAACAAGCAACTGGC | SEQ ID NO. 401 |
| PDSS1 | 220865_s_at | 0.413 | CTGTTCTTTCTGGCAGCTATCTTAC | SEQ ID NO. 402 |
| PRIM1 | 205053_at | 0.411 | CGCATCTCTGTGCCTATTGATTTGC | SEQ ID NO. 403 |
| HNRNPA1 | 222040_at | 0.409 | TAGTCATTCACCTCTGCTTATATGA | SEQ ID NO. 404 |
| NDUFAB1 | 202077_at | 0.407 | GAGGACACATTTTGGCATTCTTGCT | SEQ ID NO. 405 |
| GLTSCR2 | 217807_s_at | 0.393 | GTTGTAGCTGCCATCAGATGCCGGA | SEQ ID NO. 406 |
| RNPS1 | 200060_s_at | 0.389 | CCCCGATGACCTGGGATGGTGGCCA | SEQ ID NO. 407 |
| ICAM2 | 213620_s_at | 0.388 | GTGTCGGACAGCCAGATGGTCATCA | SEQ ID NO. 408 |
| DENND2D | 221081_s_at | 0.388 | TTCTCACTTTTCATCCAGGAAGCCG | SEQ ID NO. 409 |
| LCP1 | 208885_at | 0.383 | GGAGTCCCAAATGTCATCAGGTTTT | SEQ ID NO. 410 |
| SEPT6 | 213666_at | 0.383 | GAACCAGCACTGTTTAGCCTGATAC | SEQ ID NO. 411 |
| NUP210 | 213947_s_at | 0.383 | TAAATAGGAGCCTTTCTACTGGTTT | SEQ ID NO. 412 |
| CORO1A | 209083_at | 0.379 | GCTCCAGAAGCGCTTGGACAGGCTG | SEQ ID NO. 413 |
| SHMT2 | 214437_s_at | 0.379 | TGAAGAGCAAGACTGCCAAGCTCCA | SEQ ID NO. 414 |
| USP7 | 201498_at | 0.378 | GCCTTGGCAGACTTACGATCTCAAC | SEQ ID NO. 415 |
| GLYR1 SEPT6 | 212414_s_at | 0.376 | AATCATTTGGCATTCACATGTGGCT | SEQ ID NO. 416 |
| TUFM | 201113_at | 0.375 | TAGAGAAAGGCCAGCGTTTCACCCT | SEQ ID NO. 417 |
| RPL13A SNORD32A SNORD33 SNORD34 SNORD35A | 200715_x_at | 0.374 | TCCTCCATTGTTGCCCTGGAATGTA | SEQ ID NO. 418 |
| MYB | 204798_at | 0.374 | GCTGCTATGGTCTTAGCCTGTAGAC | SEQ ID NO. 419 |
| ICAM2 | 204683_at | 0.37 | TGAGACTCTGCACTATGAGACCTTC | SEQ ID NO. 420 |
| CYFIP2 | 215785_s_at | 0.365 | CAGCCTGCCATAGGATCCAACTGGA | SEQ ID NO. 421 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
| --- | --- | --- | --- | --- |
| BCL11A | 210347_s_at | 0.362 | GTGGAAATGCGCATGAGTCCCCAAC | SEQ ID NO. 422 |
| EZH2 | 203358_s_at | 0.358 | TTTTGCCAAGAGAGCCATCCAGACT | SEQ ID NO. 423 |
| SEPT6 | 212415_at | 0.358 | AGAAAATAGCAGACGTTTCCCTCT | SEQ ID NO. 424 |
| MRPS2 | 218001_at | 0.356 | GTGAGCGACATGTGCAGAACGGCCC | SEQ ID NO. 425 |
| HCLS1 | 202957_at | 0.355 | GGTTTGCCTCATTGTGCTATTTGCC | SEQ ID NO. 426 |
| HNRNPA1 | 214280_x_at | 0.355 | TGTTCTGCAGCTCAAATTCCATTTT | SEQ ID NO. 427 |
| CYFIP2 | 220999_s_at | 0.353 | GAGTTGATAAACATTTCCATCTTCA | SEQ ID NO. 428 |
| MYC | 202431_s_at | 0.351 | GCAACCTCACAACCTTGGCTGAGTC | SEQ ID NO. 429 |
| NCKAP1L | 209734_at | 0.35 | TGCCTATCGGGAGGTGTCTCGGGCC | SEQ ID NO. 430 |
| REPIN1 | 219041_s_at | 0.349 | GATGGAGGGCCAGCTGAGGGGAAGT | SEQ ID NO. 431 |
| MTHFD2 | 201761_at | 0.348 | GTATGTTACCCTTCAGTAAGTTCTC | SEQ ID NO. 432 |
| EWSR1 | 209214_s_at | 0.345 | CAGTGTCCCAATCCGGGTTGTGGAA | SEQ ID NO. 433 |
| GCH1 | 204224_s_at | 0.344 | TTCATATCCATGATCTTGAGTCCAT | SEQ ID NO. 434 |
| SRSF7 | 213649_at | 0.343 | CCTAGCTTCACCTTATTCTTTAAAG | SEQ ID NO. 435 |
| HNRNPA2B1 | 205292_s_at | 0.341 | GAGGATGAGAGCCCAGAGGTAACAG | SEQ ID NO. 436 |
| MZB1 | 221286_s_at | 0.341 | AAGACCAGATCTATGAAGCCCACCA | SEQ ID NO. 437 |
| ALDH5A1 | 203608_at | 0.339 | GAGCTGATCTGCATCTGTTTATCCA | SEQ ID NO. 438 |
| PPRC1 | 203737_s_at | 0.339 | TGAAACAGAGGTTCTCCGTTTTTGG | SEQ ID NO. 439 |
| PCCB | 212694_s_at | 0.339 | AGCTTCTCTACGCATTTGCTGAGGC | SEQ ID NO. 440 |
| PSMB10 | 202659_at | 0.338 | CTCACCCACAGAGCCCGTGAAGAGG | SEQ ID NO. 441 |
| ATHL1 | 219359_at | 0.338 | GCCTCTGCTACAGCGTGGAGTGGGA | SEQ ID NO. 442 |
| SLC9A3R1 | 201349_at | 0.336 | GGAAGGTGAATGTGTTCCCGTCCTC | SEQ ID NO. 443 |
| RHOH | 204951_at | 0.335 | TGTTTTCTCTGGGTACACCCCAAGC | SEQ ID NO. 444 |
| SKAP1 | 205790_at | 0.335 | GGGCCTATGGGATTGCCATGGTGAC | SEQ ID NO. 445 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| GTF3A | 215091_s_at | 0.334 | TACAACTGTGTTTAATCTCCAAAGC | SEQ ID NO. 446 |
| MIR1292 NOP56 SNORD110 SNORD57 SNORD86 | 200875_s_at | 0.333 | TCCAAAGAGGAGCCGGTCAGCAGTG | SEQ ID NO. 447 |
| MFNG | 204153_s_at | 0.331 | ATCTTCCTGCTATAAATGTGGGTGT | SEQ ID NO. 448 |
| SHMT2 | 214096_s_at | 0.331 | GTGCCCTTCAGAGCCAGTAGCAGGC | SEQ ID NO. 449 |
| PRKX PRKY | 204060_s_at | 0.33 | CTTAGTTTGATCTTCCATGGTGGAC | SEQ ID NO. 450 |
| CNBP | 206158_s_at | 0.33 | GTCTGACCTCAGTAGCTATTAAATA | SEQ ID NO. 451 |
| CD8B | 207979_s_at | 0.33 | GAGTAAGAAATGCTGCCCATGCCAC | SEQ ID NO. 452 |
| RPS3A SNORD73A | 200099_s_at | 0.328 | GACCCGAGAGGTGCAGACAAATGAC | SEQ ID NO. 453 |
| PAICS | 201014_s_at | 0.328 | GAACACTGCATATCCAGTTATCAGC | SEQ ID NO. 454 |
| CXCR4 | 209201_x_at | 0.327 | GTTGGCTGCCTTACTACATTGGGAT | SEQ ID NO. 455 |
| AKAP1 | 201675_at | 0.324 | GTAACCATTTTCTATTTGTGCAAAC | SEQ ID NO. 456 |
| LOC100506248 LOC728026 MIR1244-1 MIR1244-2 MIR1244-3 PTMA | 211921_x_at | 0.324 | GAGGATGACGATGTCGATACCAAGA | SEQ ID NO. 457 |
| FABP5 | 202345_s_at | 0.321 | GCATTGGTTCAGCATCAGGAGTGGG | SEQ ID NO. 458 |
| RNF44 | 203286_at | 0.319 | CTAGGCATGACAGTGGGCACCTTCC | SEQ ID NO. 459 |
| RNU86 RPL3 SNORD83B | 211666_x_at | 0.318 | GCCTGCGCAAGGTGGCCTGTATTGG | SEQ ID NO. 460 |
| CXCR4 | 217028_at | 0.318 | GTTTTTCCTGTTCTTAAGACGTGAT | SEQ ID NO. 461 |
| GTF3A | 201338_x_at | 0.317 | TTGGCCTCTCATCTCAGTGGATATA | SEQ ID NO. 462 |
| GMFG | 204220_at | 0.317 | AAGACCGGCAGATGGTGGTGCTGGA | SEQ ID NO. 463 |
| WDR59 | 218505_at | 0.317 | GGGCCAGTGTTACAGTGTTACCCTG | SEQ ID NO. 464 |
| NASP | 201970_s_at | 0.316 | GAGAGTCCCCGGAAAGATGATGCAA | SEQ ID NO. 465 |
| TRIM14 | 203148_s_at | 0.313 | CATGCCAGGATTTATCAGCATTCCC | SEQ ID NO. 466 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| CALML4 | 221879_at | 0.311 | AGAAATTCTTCTAGCCATGTTGATG | SEQ ID NO. 467 |
| HNRNPM | 200072_s_at | 0.309 | GCCGAGAGAGCCTGCCGGATGATGA | SEQ ID NO. 468 |
| HMGB1 | 200679_x_at | 0.309 | GAGAGGTGGAAGACCATGTCTGCTA | SEQ ID NO. 469 |
| TTF1 | 204771_s_at | 0.309 | ATTACAGAACTACCAGCATCTGCTC | SEQ ID NO. 470 |
| TSR3 | 213105_s_at | 0.309 | ACATAAATGGGCCTGGCAGCCTCGG | SEQ ID NO. 471 |
| ADA | 204639_at | 0.307 | TGGTTGAATCTGAAACCCTCCTTCT | SEQ ID NO. 472 |
| GCN1L1 | 216232_s_at | 0.307 | AACCTCCTCAAGATGCGGCAGGGTG | SEQ ID NO. 473 |
| PTMA | 208549_x_at | 0.306 | ACGCCCCTGCTGACGAGGAAAATGG | SEQ ID NO. 474 |
| DAZAP1 | 218443_s_at | 0.306 | GAGCCTTTTGTTTTACGGTATATTG | SEQ ID NO. 475 |
| THUMPD1 | 206555_s_at | 0.305 | GTTCAGAAATCACCTTTAGTCAAAA | SEQ ID NO. 476 |
| MDN1 | 212693_at | 0.305 | GTGCTCTGTTCTACTTAATGTTCTG | SEQ ID NO. 477 |
| CD53 | 203416_at | 0.301 | GCATCTTCCCATTGTCGAATTAGTC | SEQ ID NO. 478 |
| RPL13 SNORD68 | 212933_x_at | 0.301 | AATTTCAAAGCCTTCGCTAGTCTCC | SEQ ID NO. 479 |
| ADA | 216705_s_at | 0.301 | ATCAATGCGGCCAAATCTAGTTTCC | SEQ ID NO. 480 |
| CD247 | 210031_at | 0.3 | AAATTTGGCTTCTGTTGTCACCTTC | SEQ ID NO. 481 |
| FBXL14 | 213145_at | 0.3 | GTAGGATGTATATTTTCGTTGGATT | SEQ ID NO. 482 |
| TMEM177 | 218897_at | 0.3 | CGAATCAAACATTTACCCTACACCA | SEQ ID NO. 483 |
| PCBP2 | 204031_s_at | 0.298 | GATGCATCTGCTCAGACTACTTCTC | SEQ ID NO. 484 |
| UTP3 | 209486_at | 0.297 | GATCAACAAGCTGTCCGTTGTGGAT | SEQ ID NO. 485 |
| RUVBL1 | 201614_s_at | 0.296 | GTAACTGTTCCTGTGGTTGCTTTGA | SEQ ID NO. 486 |
| LGALS9 | 203236_s_at | 0.296 | ATGTGCAGACATAGGCGGCTTCCTG | SEQ ID NO. 487 |
| CXCR4 | 211919_s_at | 0.296 | GTGGTCTATGTTGGCGTCTGGATCC | SEQ ID NO. 488 |
| CD3D | 213539_at | 0.296 | GAAGCAGCCATTACCAACTGTACCT | SEQ ID NO. 489 |
| AQP3 | 39248_at | 0.296 | CTGTCATAATGCAGGCATGAAGGGT | SEQ ID NO. 490 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| CBFA2T3 | 208056_s_at | 0.294 | GAAATTCATGCTTGCACCGAGTACA | SEQ ID NO. 491 |
| SH2D1A | 211210_x_at | 0.294 | GCTTGCCACTGGGCTGGATGGCAGC | SEQ ID NO. 492 |
| HSPD1 | 200807_s_at | 0.292 | GAAGTTAAGCAGCCTTTCTGTGGAG | SEQ ID NO. 493 |
| NAP1L1 | 212967_x_at | 0.292 | ATCCTTGCTGCAGACTTCGAAATTG | SEQ ID NO. 494 |
| PTPN2 | 213137_s_at | 0.292 | GTGCTCTACGGAAACGTATTCGAGA | SEQ ID NO. 495 |
| CDK5RAP3 | 218740_s_at | 0.292 | GCAACACCTGTTTATGATCCTGGCC | SEQ ID NO. 496 |
| CHD7 | 218829_s_at | 0.292 | GCATTACCTCAGCTCTAAACTAGCC | SEQ ID NO. 497 |
| EEF1B2 SNORA41 | 200705_s_at | 0.291 | GTCTGGGGCTCATCTAAACTAGTTC | SEQ ID NO. 498 |
| ITGB7 | 205718_at | 0.291 | GACAGTCCCACTCTCTGAAGGAGGG | SEQ ID NO. 499 |
| BIN2 | 219191_s_at | 0.291 | TCTTTGACTTACGACCCATTTTGCA | SEQ ID NO. 500 |
| BLM | 205733_at | 0.29 | GAGGAAATACCCGTATCTTCCCACT | SEQ ID NO. 501 |
| SHMT2 | 214095_at | 0.29 | CAAACAGTGATTTGTCTCCCTCAAT | SEQ ID NO. 502 |
| RPS6 | 209134_s_at | 0.289 | TCCTGGACTGACTGATACTACAGTG | SEQ ID NO. 503 |
| TRBC1 | 210915_x_at | 0.288 | TGACTCCAGATACTGCCTGAGCAGC | SEQ ID NO. 504 |
| LOC100506248 LOC728026 MIR1244-1 MIR1244-2 MIR1244-3 PTMA | 200772_x_at | 0.286 | CACCATGTCAGACGCAGCCGTAGAC | SEQ ID NO. 505 |
| ATP5G2 | 208764_s_at | 0.284 | CTCTTTTGTCTGATGGTAGCCTTTC | SEQ ID NO. 506 |
| TOP1 | 208901_s_at | 0.284 | GCATTCGCTGTACCCTTTAAGATAT | SEQ ID NO. 507 |
| MX2 | 204994_at | 0.283 | TACTCCCTCAGCATCAGAGCATGCA | SEQ ID NO. 508 |
| MAP4K1 | 206296_x_at | 0.283 | TACAGGAGCTGAGAGACCCTACCCT | SEQ ID NO. 509 |
| SH2D1A | 211211_x_at | 0.283 | AGAGAAGATCCTGATGTCTGCCTGA | SEQ ID NO. 510 |
| HSPD1 | 200806_s_at | 0.282 | TAGTATCCAGTCCATTGTACCTGCT | SEQ ID NO. 511 |
| ITM2A | 202747_s_at | 0.282 | GAGCTCTTTGGCAAACTGGCGAGTG | SEQ ID NO. 512 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| ATIC | 208758_at | 0.282 | TGTGATTGAGGCCTGCGACGAACTG | SEQ ID NO. 513 |
| RPL10A | 200036_s_at | 0.281 | GACCAGCAGCACTGTGACGAGGCTA | SEQ ID NO. 514 |
| UBE2L6 | 201649_at | 0.28 | GTTTGCAGTTACAGGCCAGTTCTCC | SEQ ID NO. 515 |
| RAD51C | 209849_s_at | 0.28 | GCTGCTACAATACGGCTAATCTTTC | SEQ ID NO. 516 |
| ABCA7 | 219577_s_at | 0.28 | GGAAGGACGAGGACACCGAAGAGCA | SEQ ID NO. 517 |
| TMEM176B | 220532_s_at | 0.28 | GGGTACAGATGGATGCGGCGAAGTC | SEQ ID NO. 518 |
| MSH2 | 209421_at | 0.279 | AGCCCTGGAACTTGAGGAGTTTCAG | SEQ ID NO. 519 |
| ATP2A3 | 213036_x_at | 0.279 | AATGGGCTCCATGTTCTGTAGCCCC | SEQ ID NO. 520 |
| IFITM1 | 214022_s_at | 0.278 | TTCTTGAACTGGTGCTGTCTGGGCT | SEQ ID NO. 521 |
| SNRNP70 | 201221_s_at | 0.277 | CCATCTGCTGTGTTTGGACGCGTTC | SEQ ID NO. 522 |
| IMPDH2 | 201892_s_at | 0.277 | TCATATTGCGAAAGCCTTGGCCCTT | SEQ ID NO. 523 |
| SNRPG | 205644_s_at | 0.277 | GATGGCGACTAGTGGACAACAGAAC | SEQ ID NO. 524 |
| MAP4K1 | 214219_x_at | 0.277 | TCCCCCAGGCCTGTAGTGGTGGAGA | SEQ ID NO. 525 |
| TRA2B | 200892_s_at | 0.276 | TACTCACCTCGTCGCTATTAAAGCA | SEQ ID NO. 526 |
| RPL3 | 215963_x_at | 0.276 | TGGTGCAGATGAAACGGCAGGCTCT | SEQ ID NO. 527 |
| TRIAP1 | 218403_at | 0.276 | GTGAACACCATTTCAGAGCTCTCAG | SEQ ID NO. 528 |
| ARHGAP15 | 218870_at | 0.275 | ACGTTCACATCTGTCTTGATGCCTA | SEQ ID NO. 529 |
| PTPN2 | 213136_at | 0.274 | GATTACTTTGTATTGTACTGCCATT | SEQ ID NO. 530 |
| — | 216380_x_at | 0.274 | CAGCCACGTGCAGCCTATCAAGCTG | SEQ ID NO. 531 |
| TPT1 | 216520_s_at | 0.274 | GATATTGTCATGAACCATCACCTGC | SEQ ID NO. 532 |
| PVRIG | 219812_at | 0.274 | AGGACCCTTAGGAGTTCGATGAGAG | SEQ ID NO. 533 |
| SRSF5 | 203380_x_at | 0.273 | TAAACTGTAAATAACTTGCCCTGGG | SEQ ID NO. 534 |
| IQGAP2 | 203474_at | 0.273 | ACTGTGATATAGGTACTCTGATTTA | SEQ ID NO. 535 |
| PIM2 | 204269_at | 0.273 | TATCCCAAGTGCTCTTATTCTGGTG | SEQ ID NO. 536 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
| --- | --- | --- | --- | --- |
| CALML4 | 64408_s_at | 0.273 | CTTCTAGCCATGTTGATGGTGGACA | SEQ ID NO. 537 |
| IL2RG | 204116_at | 0.272 | GGTGTGTCTAAGGGACTGGCTGAGA | SEQ ID NO. 538 |
| PTPN7 | 204852_s_at | 0.272 | ACCTCAGGTCTACCTCAGGACTGAA | SEQ ID NO. 539 |
| ATP2A3 | 207522_s_at | 0.272 | AGGAAGATGGCCTCTGATGGACAGA | SEQ ID NO. 540 |
| NFATC3 | 210555_s_at | 0.272 | GAGCCTAACTTTGCAACCATTGGTC | SEQ ID NO. 541 |
| CD3G | 206804_at | 0.269 | TGGAGTTCGCCAGTCGAGAGCTTCA | SEQ ID NO. 542 |
| CD1C | 205987_at | 0.268 | AATATAGTGATGCCATCCCGTCGAC | SEQ ID NO. 543 |
| SLC19A1 | 211576_s_at | 0.268 | GTGGGCGCTGGGGAAGTACGTCCCA | SEQ ID NO. 544 |
| IRF7 | 208436_s_at | 0.267 | CAACAGCCTCTATGACGACATCGAG | SEQ ID NO. 545 |
| FYB | 211795_s_at | 0.267 | ATGTCCTTCGGAGTTACCTAGCGGA | SEQ ID NO. 546 |
| ITM2A | 202746_at | 0.266 | CATCCTGACAATAAATTCCATCCGT | SEQ ID NO. 547 |
| TRBC1 | 211796_s_at | 0.266 | TCGGAGAATGACGAGTGGACCCAGG | SEQ ID NO. 548 |
| BCL11B | 219528_s_at | 0.266 | TAAGGAAATCAGCCTTTCATCCCGG | SEQ ID NO. 549 |
| HMGB1 | 200680_x_at | 0.265 | GTCTATAAAGCATTTAACCCCCCTG | SEQ ID NO. 550 |
| RPL27A SNORA3 | 203034_s_at | 0.265 | TACCACTTAAAGAGGAACCAGAGCT | SEQ ID NO. 551 |
| PFDN5 | 210908_s_at | 0.265 | GCGCAGTCTATTAACATCACGGAGC | SEQ ID NO. 552 |
| IKZF1 | 205038_at | 0.264 | CCCATATCCCTTCTGTAATTTGTAC | SEQ ID NO. 553 |
| CD28 | 206545_at | 0.264 | AACAATGTCATTTGCTGCTATTATT | SEQ ID NO. 554 |
| RNU86 RPL3 SNORD83B | 212039_x_at | 0.264 | GATCAAGAACAATGCCTCCACTGAC | SEQ ID NO. 555 |
| SRSF3 | 208672_s_at | 0.263 | GAAACACAGGCCATCAGGGAAAACG | SEQ ID NO. 556 |
| ANP32B | 201305_x_at | 0.262 | AAGACCCCAGATGACCTGCAGAAAC | SEQ ID NO. 557 |
| P2RX5 | 210448_s_at | 0.262 | GGGAATAGCATTGTGCGTGTCCGGA | SEQ ID NO. 558 |
| TMPO | 203432_at | 0.261 | ATCTCTTCATTGACTGGTAGCAACC | SEQ ID NO. 559 |
| LCP2 | 205269_at | 0.261 | AAAAGATTATTTAATGCCCATTTCA | SEQ ID NO. 560 |

TABLE 5-continued

Genes predicting sensitivity to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymetrix ID | CC | Affymetrix Probe sequence | SEQ ID NO. |
|---|---|---|---|---|
| HNRPDL | 209067_s_at | 0.261 | CAATAGTGCCTATGGTGGTGATCAA | SEQ ID NO. 561 |
| TFB1M | 219169_s_at | 0.261 | TCACTCCCTTGATACAGCCCAAGAT | SEQ ID NO. 562 |
| RNU86 RPL3 SNORD83B | 211073_x_at | 0.26 | TACCATCACCGCACTGAGATCAACA | SEQ ID NO. 563 |
| TRAF3IP3 | 213888_s_at | 0.26 | GAGGCAGCGGGATGGACTACATGAC | SEQ ID NO. 564 |
| LRMP | 204674_at | 0.259 | TCCAGAAGTCTGTGGATGCCGCTCC | SEQ ID NO. 565 |
| SRSF5 | 212266_s_at | 0.259 | GCAAGTCCCGTTCTGTTAGTAGGTC | SEQ ID NO. 566 |
| TAPBPL | 218747_s_at | 0.259 | CAGAGACGGCAAGCACCTACAGGAC | SEQ ID NO. 567 |
| LBR | 201795_at | 0.258 | AAAGTGGTGGCGTTTTCTGTACTGG | SEQ ID NO. 568 |
| SP110 | 208392_x_at | 0.258 | ATGACCCTAGGAGAGCTGCTGAAGC | SEQ ID NO. 569 |
| RGPD3 RGPD4 RGPD5 RGPD6 RGPD8 | 210676_x_at | 0.258 | AGGAGCCTCCATTATGGCATGCTGA | SEQ ID NO. 570 |
| CBWD1 CBWD2 CBWD3 CBWD5 CBWD6 CBWD7 LOC100653334 | 220175_s_at | 0.257 | GATTGTCCAGGGTGTCCATGAGCTC | SEQ ID NO. 571 |
| ATP5D | 203926_x_at | 0.255 | GATCCAGATCCGAATCGAGGCCAAC | SEQ ID NO. 572 |
| IGJ | 212592_at | 0.255 | AAACATGTTCTAGAACTAGTTACAA | SEQ ID NO. 573 |
| RPLP0 | 214167_s_at | 0.255 | CCAGCCCAGAACACTGGTCTCGGGC | SEQ ID NO. 574 |
| USH1C | 211184_s_at | 0.254 | ACACACACCAGATGGCATCCTTGGG | SEQ ID NO. 575 |
| PTPRCAP | 204960_at | 0.253 | CCTCCATGTCACCGCACTGTAGAGG | SEQ ID NO. 576 |
| AARSD1 PTGES3L-AARSD1 | 222064_s_at | 0.252 | ACCTGAATCTGCTCAGAGACCTGGC | SEQ ID NO. 577 |
| SH2D1A | 210116_at | 0.251 | ATGGGTGGTTTACCATTTCTTGAGG | SEQ ID NO. 578 |

TABLE 6

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| LPP | 202822_at | -0.51 | CATTTCTTGGGATCGCTCGTTTGGT | SEQ ID NO. 579 |
| RHOC | 200885_at | -0.495 | AGAACAAGCGTCGGAGGGGCTGTCC | SEQ ID NO. 580 |
| CAPN2 | 208683_at | -0.483 | AATCAAGTTCTTGACCCTATTCGGC | SEQ ID NO. 581 |
| FLNA | 200859_x_at | -0.469 | TCTCGGCTTTCACTTGGGCAGAGGG | SEQ ID NO. 582 |
| WDR1 | 200609_s_at | -0.467 | AGTGTGTGACTCACACCTTGTGGCT | SEQ ID NO. 583 |
| FLNA | 214752_x_at | -0.465 | CCCCCTGCGAGGAGATCCTGGTGAA | SEQ ID NO. 584 |
| ACTN1 | 208637_x_at | -0.458 | GGCGCTGTACGGCGAGAGTGACCTC | SEQ ID NO. 585 |
| CNN3 | 201445_at | -0.457 | TCTTCCCTCAATAGTTGCCTTTTAG | SEQ ID NO. 586 |
| FLNA | 213746_s_at | -0.456 | GAGCAGCTTCACAGTAGACTGCAGC | SEQ ID NO. 587 |
| ACTN1 | 208636_at | -0.455 | AAATCCCCTCAGAGGTGTGACTAGT | SEQ ID NO. 588 |
| ALCAM | 201952_at | -0.44 | TTCGGCTCTCCAATTTAACTCTTTG | SEQ ID NO. 589 |
| CD44 | 212063_at | -0.438 | TGTCTCCTGAAGACTTCCCTTAAAA | SEQ ID NO. 590 |
| CAV2 | 203323_at | -0.437 | GATGAGCAGACTTCTCGGAATTCAT | SEQ ID NO. 591 |
| PRSS23 | 202458_at | -0.435 | AACGTGGCTGTCAGAATCACTCCTC | SEQ ID NO. 592 |
| F3 | 204363_at | -0.427 | GACATTGGTATTCTGGGCAGCTTCC | SEQ ID NO. 593 |
| RAB31 | 217763_s_at | -0.425 | GTGCCATCGTGGTTGAGACAAGTGC | SEQ ID NO. 594 |
| ACTN4 | 200601_at | -0.423 | GAGGAGCTGAGTTGGCAGACCGGGC | SEQ ID NO. 595 |
| CAV2 | 203324_s_at | -0.423 | GAGAATATACAATGATCCTGGAAAT | SEQ ID NO. 596 |
| CYR61 | 210764_s_at | -0.423 | GCCAATGAAGCAGCGTTTCCCTTCT | SEQ ID NO. 597 |
| LMNA | 212086_x_at | -0.422 | CAGTGACTGTGGTTGAGGACGACGA | SEQ ID NO. 598 |
| PSMD2 | 200830_at | -0.419 | CAGTGTTGTTGGCCCACGGGGAACG | SEQ ID NO. 599 |
| FKBP9 | 212169_at | -0.415 | AATAACCACATGGCTACCTTCTATC | SEQ ID NO. 600 |
| CYR61 | 201289_at | -0.414 | GCATTCCATCCCTTCCTGAAGGGGG | SEQ ID NO. 601 |
| WDR1 | 200611_s_at | -0.413 | AGGAGTGGACAATCACCTACTGAGG | SEQ ID NO. 602 |

TABLE 6-continued

Genes predicting resistance to oxaliplatin ranked in order of
correlation coefficient (CC). Affymetrix IDs listed are publically
available online at the Affymetrix NetAffx ™ Analysis Center.
The probe sequence shows the sequence of one (median) of 11 probes
listed by Affymetrix for that Affymetrix ID.

| Gene | Affymerix ID | CC | Affymetrix Probe sequence | SEQ ID NO. |
|---|---|---|---|---|
| CAV1 | 203065_s_at | −0.413 | GGTGCCAATTTCAAGTTCCAAGTTG | SEQ ID NO. 603 |
| CAV1 | 212097_at | −0.41 | AATTTTTTATCATGCATGTCCTGTA | SEQ ID NO. 604 |
| CYP1B1 | 202436_s_at | −0.409 | GTGCTTGGAGTTTACCTGGCTTATT | SEQ ID NO. 605 |
| CD44 | 204489_s_at | −0.408 | GTGTGCTATGGATGGCTTCTAACAA | SEQ ID NO. 606 |
| COTL1 | 221059_s_at | −0.408 | GCACATTTGATATAGCTCTTTTTCT | SEQ ID NO. 607 |
| EPAS1 LOC100652809 | 200878_at | −0.407 | CCAAGCTTCATATTAACCCTACCTG | SEQ ID NO. 608 |
| RAB31 | 217762_s_at | −0.406 | AACTGTTAGCAAGCGGCATTTGGAT | SEQ ID NO. 609 |
| RAB31 | 217764_s_at | −0.406 | AGACCCTGTAGTCCAGTGGTGCTGC | SEQ ID NO. 610 |
| RRBP1 | 201206_s_at | −0.405 | GACCCCGTTCAGCTGAAGACGCAGC | SEQ ID NO. 611 |
| CKAP4 | 200999_s_at | −0.404 | GGGAATGCAGGCCAAGTCCTTTTAT | SEQ ID NO. 612 |
| RND3 | 212724_at | −0.404 | ATAGCTGGCGAGTGCTTTCTGTATT | SEQ ID NO. 613 |
| CD44 | 209835_x_at | −0.403 | GGACACCCCAAATTCCAGAATGGCT | SEQ ID NO. 614 |
| LOXL2 | 202998_s_at | −0.402 | GTGTAAGTGACTCATCTTCCTGTTG | SEQ ID NO. 615 |
| LEPROT | 202378_s_at | −0.401 | ACATGTGCACATGCGGCATTTTACT | SEQ ID NO. 616 |
| ATP2B4 | 212135_s_at | −0.4 | GTGGAAAAGCCTCTAAATGCATCCC | SEQ ID NO. 617 |
| TMEM158 | 213338_at | −0.399 | AAAGCAAGGTTTGTGCTGCGCTTCC | SEQ ID NO. 618 |
| ANXA2 | 210427_x_at | −0.398 | ACCAGCTTGCGAATAACAGTCCCCG | SEQ ID NO. 619 |
| S100A11 | 200660_at | −0.397 | AATACAGAACTAGCTGCCTTCACAA | SEQ ID NO. 620 |
| SDC4 | 202071_at | −0.397 | CAGCGAGAGCATGTCCATCTGTTGG | SEQ ID NO. 621 |
| PEA15 | 200787_s_at | −0.396 | CACCCACCTGTACTCTGGAGAGACT | SEQ ID NO. 622 |
| CD44 | 212014_x_at | −0.395 | GAGTCGTCAGAAACTCCAGACCAGT | SEQ ID NO. 623 |
| FNDC3B | 218618_s_at | −0.395 | CAACACAGACTACAGGTTCCGCGTA | SEQ ID NO. 624 |
| LOX | 204298_s_at | −0.394 | TCATGCGTATGCCTCAGGCTGCACA | SEQ ID NO. 625 |
| ANXA2 | 213503_x_at | −0.394 | CAGAAAGCGCTGCTGTACCTGTGTG | SEQ ID NO. 626 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| COL4A1 | 211980_at | −0.393 | CATTAGTATTCCTCATTCTGCATCC | SEQ ID NO. 627 |
| YPEL5 | 217783_s_at | −0.389 | AACTGTACTTTGTACCCTCACATAC | SEQ ID NO. 628 |
| TNFRSF12A | 218368_s_at | −0.384 | AACACTAGGGGCTGGCCCACTAGGA | SEQ ID NO. 629 |
| PDLIM7 | 203370_s_at | −0.382 | CAAGACGCCCATCCGGAACAGGGCC | SEQ ID NO. 630 |
| CD44 | 204490_s_at | −0.382 | GGGAGCTGGGACACTTAACAGATGC | SEQ ID NO. 631 |
| ANXA2 | 201590_x_at | −0.381 | GCTGATCGGCTGTATGACTCCATGA | SEQ ID NO. 632 |
| MAP1B | 212233_at | −0.381 | GTGGCAGTTCAGAGACACGCTTTTC | SEQ ID NO. 633 |
| EXT1 | 201995_at | −0.38 | ATACCGAGACATTGAGCGACTTTGA | SEQ ID NO. 634 |
| IL6ST | 212195_at | −0.379 | TTTCTTGAACACAGGCTTTGTCTGA | SEQ ID NO. 635 |
| CAST | 212586_at | −0.379 | AAGCAGCCCTTTTTACAGTCTAGTT | SEQ ID NO. 636 |
| SGCE | 204688_at | −0.378 | CTTGCTTATATCATGTGCTGCCGAC | SEQ ID NO. 637 |
| LEPRE1 | 220750_s_at | −0.378 | GATGAGCTATGACAGCGTCCAGGTC | SEQ ID NO. 638 |
| CYP1B1 | 202437_s_at | −0.376 | CTCATTACTTATACTGGGACACCAT | SEQ ID NO. 639 |
| CALU | 200757_s_at | −0.375 | GGTATAATGTAACTTCACCCCAGCC | SEQ ID NO. 640 |
| BHLHE40 | 201170_s_at | −0.375 | GGCATATGGAGTGTCCTTATTGCTA | SEQ ID NO. 641 |
| MAP1LC3B | 208786_s_at | −0.372 | GTACTTGCATGGGGTTCACTATTTA | SEQ ID NO. 642 |
| MYOF | 201798_s_at | −0.37 | GGCTTCATTTCAAGAGTCATCCAGC | SEQ ID NO. 643 |
| PTRF | 208790_s_at | −0.368 | CCCCGCTTGGACACAGTCCGAGTGG | SEQ ID NO. 644 |
| TRAM2 | 202369_s_at | −0.367 | GTCACTCTGCCTAAAAGCACTCTAG | SEQ ID NO. 645 |
| C20orf3 | 206656_s_at | −0.365 | GCTCCTTGCACTTGGAACAGGGCTC | SEQ ID NO. 646 |
| TPM4 | 209344_at | −0.364 | GTCATAACCCACAGATAGATCAACC | SEQ ID NO. 647 |
| S100A10 | 200872_at | −0.362 | TCAAAAAGACCCTCTGGCTGTGGAC | SEQ ID NO. 648 |
| FAM50A | 203262_s_at | −0.362 | GCGCTCGAGATCCTTCGGAAAGACT | SEQ ID NO. 649 |
| PTRF | 208789_at | −0.362 | CCAGGTTCTCAAGACACGAGTCCCC | SEQ ID NO. 650 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| ACTB ACTB LOC100505829 | AFFX-HSAC07/X00351_5_at | -0.362 | GAAGGATTCCTATGTGGGCGACGAG | SEQ ID NO. 651 |
| LRP12 | 219631_at | -0.361 | TGGACCCTAGGGATTTGCACTAAAA | SEQ ID NO. 652 |
| PPIC | 204517_at | -0.357 | GAACTTAAATATATCCCCTTCCTCA | SEQ ID NO. 653 |
| MYOF | 211864_s_at | -0.357 | TACCAAATCGACCAGAAACCTCCTT | SEQ ID NO. 654 |
| LGALS1 | 201105_at | -0.355 | GCTTCGTGCTGAACCTGGGCAAAGA | SEQ ID NO. 655 |
| LAMB1 | 201505_at | -0.355 | AAGAGTCAGCTGATGCCAGAAGGAA | SEQ ID NO. 656 |
| FAM171A1 | 212771_at | -0.355 | GTGTAACGTGGGTTCTGTTTAGCGA | SEQ ID NO. 657 |
| PTPRK | 203038_at | -0.354 | CCTGTGGCCCAGCACTGGTCAAGAA | SEQ ID NO. 658 |
| GRB10 | 209409_at | -0.353 | AACCTTTATTCCATGTGCTTTGCTT | SEQ ID NO. 659 |
| GALNT2 | 217788_s_at | -0.352 | GACTTACTGCGGTTGCGTTAGTTTC | SEQ ID NO. 660 |
| CDH11 | 207173_x_at | -0.351 | AGTTCTGAGCTGTAATTTCGCCTTA | SEQ ID NO. 661 |
| LOXL2 | 202997_s_at | -0.35 | TCTCAGGGCTGCAACCACGAGGAGG | SEQ ID NO. 662 |
| MAPK1 | 212271_at | -0.348 | GTGGAGTTGACTCGGTGTTCTGTCC | SEQ ID NO. 663 |
| LDLR | 202068_s_at | -0.347 | TTGTTCAGTGACTATTCTCGGGGCC | SEQ ID NO. 664 |
| CD44 | 210916_s_at | -0.347 | AAAATGGTCGCTACAGCATCTCTCG | SEQ ID NO. 665 |
| MXRA7 | 212509_s_at | -0.347 | GATCAGTCTCAAATGGGTTTCTTGG | SEQ ID NO. 666 |
| PLOD2 | 202620_s_at | -0.346 | TTATCAAGTGTCAAGATCAGCAAGT | SEQ ID NO. 667 |
| C19orf10 | 221739_at | -0.345 | CATCCTTCATGAGCCTGCAGAACTG | SEQ ID NO. 668 |
| CD59 | 200983_x_at | -0.344 | GTCTTCTGCCATTCAGGTCATAGCC | SEQ ID NO. 669 |
| EGFR | 201983_s_at | -0.344 | GTGTCAACAGCACATTCGACAGCCC | SEQ ID NO. 670 |
| PLAU | 205479_s_at | -0.342 | AGCAGCTGAGGTCTCTTGAGGGAGC | SEQ ID NO. 671 |
| TUBB6 | 209191_at | -0.342 | GATCACACCATGGAGACTTTCTACT | SEQ ID NO. 672 |
| MPRIP | 214771_x_at | -0.34 | GACTTCCTGTTGTCTTCATCAAAGC | SEQ ID NO. 673 |
| RAB32 | 204214_s_at | -0.339 | GGAGAAGTATCCCTGCTAGTGGCTC | SEQ ID NO. 674 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| MDFIC | 211675_s_at | −0.339 | GTTACAGGCGGTGTCCTTTTAAATG | SEQ ID NO. 675 |
| PLAU | 211668_s_at | −0.336 | GGAATTGTGAGCTGGGGCCGTGGAT | SEQ ID NO. 676 |
| CORO1C | 221676_s_at | −0.336 | CCACCGCTCTCATTTCATGGAGTCT | SEQ ID NO. 677 |
| JAK1 | 201648_at | −0.335 | CTTTGGGGCAAGCTATTCCAGCACT | SEQ ID NO. 678 |
| TMBIM1 | 217730_at | −0.335 | CCTACTGTGGTACTGAAGACTTCTG | SEQ ID NO. 679 |
| VCAN | 221731_x_at | −0.335 | GAAATGGTTTCACTTGCTCTTTGAC | SEQ ID NO. 680 |
| EPHA2 | 203499_at | −0.334 | AGGGACCGGTGCTGCAGGAGTGTCC | SEQ ID NO. 681 |
| EHD2 | 221870_at | −0.334 | TATTTAAGTGGAGCCCCTACGTAGA | SEQ ID NO. 682 |
| CRIM1 | 202552_s_at | −0.333 | GGTAATTAATCCATTCCTGGCATAA | SEQ ID NO. 683 |
| ULK2 | 204062_s_at | −0.333 | GTGGAGTTCCTACATGCAGTGAGTG | SEQ ID NO. 684 |
| KDELR3 | 204017_at | −0.332 | AGTAATCAGTCAATCCAATATCCCC | SEQ ID NO. 685 |
| RRAS | 212647_at | −0.332 | GACGAGGCTTTTGAGCAGCTGGTGC | SEQ ID NO. 686 |
| CD59 | 200985_s_at | −0.331 | GGTAGGATATCTTGGCTTTGCCACA | SEQ ID NO. 687 |
| EHD2 | 45297_at | −0.331 | CTGAACGGAACAGTGTCCCCACAGA | SEQ ID NO. 688 |
| MYL9 | 201058_s_at | −0.33 | GCGTGCCGAGCTGAGGCAGATGTTC | SEQ ID NO. 689 |
| P4HA1 | 207543_s_at | −0.33 | GGGTGGTAATATTGGCATTCTGATT | SEQ ID NO. 690 |
| LAMB3 | 209270_at | −0.33 | AATGCTTTCCATCTCCAGGAGACTT | SEQ ID NO. 691 |
| PTPLA | 219654_at | −0.328 | GACAGAGATCACTCGCTATTCCTTC | SEQ ID NO. 692 |
| NT5E | 203939_at | −0.327 | ATAGGAAGTATGTTTGTTTCTTAGT | SEQ ID NO. 693 |
| OPTN | 202074_s_at | −0.326 | GGAATATTCCGATTCATTCCTGCCC | SEQ ID NO. 694 |
| COL4A2 | 211966_at | −0.326 | TGTGGATCGGATATTCCTTCCTCAT | SEQ ID NO. 695 |
| CALU | 200755_s_at | −0.325 | GGCAAGGAAAGATCCCTTTGCTCTA | SEQ ID NO. 696 |
| — | 208540_x_at | −0.325 | GACTGAGCGGTGCATTGAGTCCCTG | SEQ ID NO. 697 |
| NR3C1 | 211671_s_at | −0.325 | ACCAGTGCCCAAAGTCTGTGTGATG | SEQ ID NO. 698 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| NR3C1 | 201865_x_at | −0.324 | GAACTACGCTTGCTCATTTTTTCTT | SEQ ID NO. 699 |
| KDELR2 | 200699_at | −0.323 | TAACCTTGGCTATGTTACCACCGTT | SEQ ID NO. 700 |
| SEPT7 | 213151_s_at | −0.323 | TAATGACCAACCTGTTTCTACCTAT | SEQ ID NO. 701 |
| NFIB | 209289_at | −0.322 | TGCACGAAGATATAATGTCCACATT | SEQ ID NO. 702 |
| AHNAK | 211986_at | −0.321 | CAGACGGAGGTCAGGTCTTCCTCTT | SEQ ID NO. 703 |
| IL6ST | 212196_at | −0.321 | GACAAAACTAGTTCACTCACTGCTT | SEQ ID NO. 704 |
| VCAN | 204620_s_at | −0.32 | GGCTGGAAATGGTTTCACTTGCTCT | SEQ ID NO. 705 |
| SCRN1 | 201462_at | −0.319 | AGCACAAGCTTATGCTTCCCGTAGC | SEQ ID NO. 706 |
| MARCKS | 201670_s_at | −0.319 | CTTTGTCAATCTATGGACATGCCCA | SEQ ID NO. 707 |
| TPM4 | 212481_s_at | −0.319 | TGCCATCTTCGCTTTGCTGGAAATG | SEQ ID NO. 708 |
| ANXA2P2 | 208816_x_at | −0.317 | CAGAAAGCGCTGCTGTACCTGTGTG | SEQ ID NO. 709 |
| MECOM | 221884_at | −0.317 | AGTCCAAATCGCAGGCATATGCTAT | SEQ ID NO. 710 |
| MVP | 202180_s_at | −0.316 | AGACAACCACGTGGTGCCTGTACTG | SEQ ID NO. 711 |
| NFIB | 209290_s_at | −0.316 | GAATCACTATTCCTGGTTATCTCAC | SEQ ID NO. 712 |
| FAM190B | 209379_s_at | −0.316 | GTGGGCACCAATCTACAACTATGTC | SEQ ID NO. 713 |
| FOSL1 | 204420_at | −0.315 | AGGGCAGCTGCTATTTATTTTCCTA | SEQ ID NO. 714 |
| PLAUR | 210845_s_at | −0.314 | TCTCCTCTGGACCTAAACCTGAAAT | SEQ ID NO. 715 |
| GRB10 | 210999_s_at | −0.314 | GAACTCTTGCCCTGGAATAATCTTG | SEQ ID NO. 716 |
| TAGLN2 | 200916_at | −0.312 | AGCTGTGGCTGCAGGAACTTAATTT | SEQ ID NO. 717 |
| COL6A1 | 212091_s_at | −0.312 | TCACAGCGGGCAGGACGGACCCCGC | SEQ ID NO. 718 |
| RRBP1 | 201204_s_at | −0.309 | GCCCCAGTTTGTAAATGAACCTGTG | SEQ ID NO. 719 |
| TXNRD1 | 201266_at | −0.309 | TGGCATTTAGGCAGCAGAGCCCCTG | SEQ ID NO. 720 |
| AURKA | 204092_s_at | −0.309 | TTTTTTCTCTGGTGGCATTCCTTTA | SEQ ID NO. 721 |
| RRAS2 | 212589_at | −0.309 | TCAAGTGTGTACAACAGTCCCATGA | SEQ ID NO. 722 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| LRP12 | 220253_s_at | −0.308 | CCTGATACTGTAGTTCACTGTAGAA | SEQ ID NO. 723 |
| NPC1 | 202679_at | −0.306 | TCTTCACAGTGTTCCCCTAGAAAGG | SEQ ID NO. 724 |
| AXL | 202686_s_at | −0.306 | AGATTCTAACGGTCTGTTCTGTTTC | SEQ ID NO. 725 |
| GATA6 | 210002_at | −0.306 | GCGTTGCAGCAATCAGTGTTAAATC | SEQ ID NO. 726 |
| CAMSAP2 | 212765_at | −0.305 | GAGCATTGCTTACAGGTTTTTTGTT | SEQ ID NO. 727 |
| ZDHHC7 | 218606_at | −0.305 | GTCTGAGGGTCTTCCTTTATGCTTG | SEQ ID NO. 728 |
| HK1 | 200697_at | −0.304 | AATCGTGTGTCCGTGGAACCAGTCC | SEQ ID NO. 729 |
| MARCKS | 201668_x_at | −0.303 | TGCTTTTTGATCTCTTCGACTAAAA | SEQ ID NO. 730 |
| NFIB | 213032_at | −0.303 | GAAGTATGGCTTTTTATGCATCCTT | SEQ ID NO. 731 |
| ATP1B1 | 201242_s_at | −0.302 | ATATGCTTTACACTAGCTTTCTGCA | SEQ ID NO. 732 |
| BASP1 | 202391_at | −0.302 | AGTGACAAACATTCTCTCATCCTAC | SEQ ID NO. 733 |
| BCL6 | 203140_at | −0.301 | AAACTGCGTTAAAGGCTCGATTTTG | SEQ ID NO. 734 |
| ID3 | 207826_s_at | −0.301 | GTGGCCTGAAGAGCCAGAGCTAGCT | SEQ ID NO. 735 |
| RRAS2 | 212590_at | −0.301 | AATGATCACCATGTTAGCCTTAGAC | SEQ ID NO. 736 |
| SPATS2L | 222154_s_at | −0.301 | TTTTCACTCAGTTTTGGTTCCCTGC | SEQ ID NO. 737 |
| PMP22 | 210139_s_at | −0.3 | GACCGTGAGTTCCTAGAGCTTGGCT | SEQ ID NO. 738 |
| CDC14B | 221556_at | −0.3 | ATCCGATGATAGTACTGCAGTTTTC | SEQ ID NO. 739 |
| FHL2 | 202949_s_at | −0.299 | CTCACCCAGGCAATCTTGCCTTCTG | SEQ ID NO. 740 |
| PRNP | 201300_s_at | −0.298 | AGCAGTTAACATCTGAAGTGTCTAA | SEQ ID NO. 741 |
| MARCKS | 201669_s_at | −0.298 | AAATCTTGATATCCAGAAGCACATG | SEQ ID NO. 742 |
| ADAMTS1 | 222162_s_at | −0.298 | GACACAATGAGCTTAGTACCTCCAA | SEQ ID NO. 743 |
| KCMF1 | 217938_s_at | −0.296 | CTCTCCTAATACTCCACATTCAAAC | SEQ ID NO. 744 |
| CTSA | 200661_at | −0.295 | TCCCGCAGCAGTTCCTGAATGGGGT | SEQ ID NO. 745 |
| TPBG | 203476_at | −0.295 | AGGGGATTTGCTTCCTTGTTATGTA | SEQ ID NO. 746 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| CCND1 | 208712_at | −0.295 | CGCAAGTCTGAGGGTCTGGGCGGCG | SEQ ID NO. 747 |
| CASK | 211208_s_at | −0.294 | AATGTGATACTGTCTCTTTGAAGCA | SEQ ID NO. 748 |
| ZYX | 200808_s_at | −0.293 | CTGACCCAGGACCCAACATGGTCTA | SEQ ID NO. 749 |
| VEGFA | 210512_s_at | −0.293 | TCTACATACTAAATCTCTCTCCTTT | SEQ ID NO. 750 |
| HBXIP | 202300_at | −0.292 | TTGATGCTCATATCTGTTCTTCAGC | SEQ ID NO. 751 |
| ZCCHC14 | 212655_at | −0.292 | ATTGCTCCACTGTTCACCAAGGAAG | SEQ ID NO. 752 |
| CDC42BPA | 214464_at | −0.292 | TCCCACCTCACTGGATCTTGATGTT | SEQ ID NO. 753 |
| CD63 | 200663_at | −0.29 | CCCGACTCCTGCTGCATTAATGTTA | SEQ ID NO. 754 |
| ADAM9 | 202381_at | −0.29 | AAATATGTTGATTCATGGCTATAAT | SEQ ID NO. 755 |
| LIF | 205266_at | −0.29 | GATGGTACAGATGTTCCTGCCTTAG | SEQ ID NO. 756 |
| SPTBN1 | 200671_s_at | −0.289 | ATGACAGTTTCACAACCTGCATTGA | SEQ ID NO. 757 |
| RBPMS | 209488_s_at | −0.289 | AAGCTCACATCTAAACAGCCTGTAG | SEQ ID NO. 758 |
| DKK1 | 204602_at | −0.288 | TTACCCCATTTAATTCTAGAGTCTA | SEQ ID NO. 759 |
| TGFBR2 | 208944_at | −0.288 | TAGAGGCGCCTAGAAATTCCACTTG | SEQ ID NO. 760 |
| POFUT2 | 209578_s_at | −0.288 | AGGGCAACGCTAGACACAGAATCCG | SEQ ID NO. 761 |
| ARID5B | 212614_at | −0.288 | GTGAGACCCATACCATTGCAATGAT | SEQ ID NO. 762 |
| PYGL | 202990_at | −0.287 | GGAACGTGGAACCTTCAGATCTAAA | SEQ ID NO. 763 |
| LDOC1 | 204454_at | −0.287 | CACTTCTTTTTTCCTATGCACTGGT | SEQ ID NO. 764 |
| PPAP2B | 212226_s_at | −0.287 | GCACCATCCCAGTGATGTTCTGGCA | SEQ ID NO. 765 |
| FTH1 | 214211_at | −0.287 | GCCGTTGTTCAGTTCTAATCACACT | SEQ ID NO. 766 |
| SVIL | 202565_s_at | −0.286 | AGCTCTGCCACCAATATGTATCTTC | SEQ ID NO. 767 |
| PLEC | 201373_at | −0.285 | CAGGTGGAGGTGTCAGGCTGCTGGC | SEQ ID NO. 768 |
| PHACTR2 | 204048_s_at | −0.285 | GTCAAAGCAACCATACTTCACCTAG | SEQ ID NO. 769 |
| FLNB | 208613_s_at | −0.285 | GCCAGCGTCTAGTTAGCCCTGGCTC | SEQ ID NO. 770 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
| --- | --- | --- | --- | --- |
| ZYX | 215706_x_at | −0.283 | ACTGCTAGAGCCCAGACCTGAGTGA | SEQ ID NO. 771 |
| GJA1 | 201667_at | −0.282 | CTACGGTCATGTTCAGCTTCATTGC | SEQ ID NO. 772 |
| KCTD12 | 212192_at | −0.282 | CAGGCATCTGAAAACCTTATCTGCT | SEQ ID NO. 773 |
| RABAC1 | 203136_at | −0.281 | GGAGTCCAAGCTTGTGCTCTTTGGC | SEQ ID NO. 774 |
| SLC39A7 | 202667_s_at | −0.28 | ACATCAATCGTGTGTCCTGATTTGG | SEQ ID NO. 775 |
| ELF4 | 31845_at | −0.28 | AGTGCCTGAGGACCTTTGCTGTGTC | SEQ ID NO. 776 |
| SERPINH1 | 207714_s_at | −0.278 | TGGGGGGAGGTGAGGTACCAGCCT | SEQ ID NO. 777 |
| MALT1 | 210017_at | −0.277 | TCGGCACTACTTCTATTCAGCATTG | SEQ ID NO. 778 |
| PPAP2B | 212230_at | −0.277 | CCTTCTACTGAACCTTTGAGGAAAG | SEQ ID NO. 779 |
| NPC2 | 200701_at | −0.276 | GCATCTGGCCAATGAGTCTGCTGAG | SEQ ID NO. 780 |
| CD55 | 201925_s_at | −0.276 | GATCTGTAATGTTATTTCCACTTAT | SEQ ID NO. 781 |
| SYNJ2 | 212828_at | −0.276 | TGGTAGGATTCCCAGGTCAGCAGCA | SEQ ID NO. 782 |
| MICALL1 | 55081_at | −0.276 | TGCCCAGCAGCTCTTGGTCAAAGCA | SEQ ID NO. 783 |
| ITGA5 | 201389_at | −0.275 | GAAGCCAGGAATTTCCCAGGACCTG | SEQ ID NO. 784 |
| TFE3 | 212457_at | −0.275 | ATAAAAGCTAGGCGTGTTTGATGCG | SEQ ID NO. 785 |
| CREB3L1 | 213059_at | −0.275 | GCCGCTGGGCCTTTTTAATTGCCAA | SEQ ID NO. 786 |
| SOGA2 | 213358_at | −0.275 | ATGTGACTCAGTCTGTTCCACTGTA | SEQ ID NO. 787 |
| COL5A2 | 221729_at | −0.275 | GGTGCTATGCTTCTGTTATTATTCC | SEQ ID NO. 788 |
| TIMP1 | 201666_at | −0.274 | GACCACCTTATACCAGCGTTATGAG | SEQ ID NO. 789 |
| COL6A2 | 209156_s_at | −0.274 | TCACGGGCAACGACAGTCTGCACGA | SEQ ID NO. 790 |
| RYBP | 201846_s_at | −0.273 | GAATTTCGCACCCTGACGATTACTC | SEQ ID NO. 791 |
| WNT5A | 205990_s_at | −0.273 | ACATCCCCTCAGTTGCAGTGAATTG | SEQ ID NO. 792 |
| SEC61A1 | 217716_s_at | −0.273 | GGACTGTCACTGTGGACGCCAAAAT | SEQ ID NO. 793 |
| SNAPC1 | 205443_at | −0.272 | GGTCAAGGGCAAGTCAAAGCAACTA | SEQ ID NO. 794 |

TABLE 6-continued

Genes predicting resistance to oxaliplatin ranked in order of correlation coefficient (CC). Affymetrix IDs listed are publically available online at the Affymetrix NetAffx™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| LAPTM4B | 214039_s_at | −0.272 | TTTTTACCTTGACTACCTGAATTGC | SEQ ID NO. 795 |
| FOXN3 | 218031_s_at | −0.272 | CGTGAGATGCTCACGAGTACCCTTC | SEQ ID NO. 796 |
| PPP4R1 | 201594_s_at | −0.271 | CCAGCCCTGTGTGTGAATCGTTTGT | SEQ ID NO. 797 |
| YES1 | 202932_at | −0.271 | GACACTCTCTACCAAGAGGGTCTTC | SEQ ID NO. 798 |
| HABP4 | 209818_s_at | −0.271 | AGAGGCTCGAGAGCAGGCCATTTCC | SEQ ID NO. 799 |
| HSBP1 | 200941_at | −0.27 | GTGACTTAGGCAGGAGTCGACCTCC | SEQ ID NO. 800 |
| RCN1 | 201063_at | −0.27 | TATCAGATTCTTTCTTTTCGACTTT | SEQ ID NO. 801 |
| YWHAZ | 200640_at | −0.269 | CAAGATTACCTTCCTGTTTTAGCCT | SEQ ID NO. 802 |
| VIM | 201426_s_at | −0.268 | TGTGGATGTTTCCAAGCCTGACCTC | SEQ ID NO. 803 |
| ID1 | 208937_s_at | −0.268 | GTGCGCTGTCTGTCTGAGCAGAGCG | SEQ ID NO. 804 |
| ZNF264 | 205917_at | −0.267 | TTATTGACCTTCCATGGTCCTCACT | SEQ ID NO. 805 |
| CD55 | 201926_s_at | −0.266 | GTTGACAGGTTTGCTTGGGACGCTA | SEQ ID NO. 806 |
| CTNNAL1 | 202468_s_at | −0.266 | ACGGATGGGTCTCAGTTACAAATAA | SEQ ID NO. 807 |
| JUN | 201466_s_at | −0.265 | AGGTGCTTATTCTCAAAGCAGGAAT | SEQ ID NO. 808 |
| VOPP1 | 208091_s_at | −0.265 | GACAACTGCGTGGGTCCAAACACTC | SEQ ID NO. 809 |
| IL8 | 202859_x_at | −0.264 | GCTGTGTTGGTAGTGCTGTGTTGAA | SEQ ID NO. 810 |
| AMOTL2 | 203002_at | −0.264 | TATCGTTTTTAGGTTTGGTATGTGT | SEQ ID NO. 811 |
| CETN2 | 209194_at | −0.264 | GCATTTCCACATATCCACAAACACA | SEQ ID NO. 812 |
| KRT14 | 209351_at | −0.264 | AAGGTCATGGATGTGCACGATGGCA | SEQ ID NO. 813 |
| IGFBP3 | 210095_s_at | −0.264 | GAGTCATTCTCATGCTTTTCTTTAT | SEQ ID NO. 814 |
| ZFP36L1 | 211962_s_at | −0.264 | GGACTGCAAATTGAGTTTCTTTCTC | SEQ ID NO. 815 |
| MAP7D1 | 217943_s_at | −0.264 | CTCAGTGCATTCGTGTGCTCGCACG | SEQ ID NO. 816 |
| DNAJB1 | 200664_s_at | −0.263 | GGACCTTTCTACCAGTTGTGGACCA | SEQ ID NO. 817 |
| RNH1 | 206050_s_at | −0.263 | CTGGTCCTGTACGACATTTACTGGT | SEQ ID NO. 818 |

TABLE 6-continued

Genes predicting resistance to oxaliplatin ranked in order of correlation coefficient (CC). Affymetrix IDs listed are publically available online at the Affymetrix NetAffx ™ Analysis Center. The probe sequence shows the sequence of one (median) of 11 probes listed by Affymetrix for that Affymetrix ID.

| Gene | Affymerix ID | CC | Affymetrix Probe sequence | SEQ ID NO. |
|---|---|---|---|---|
| AMIGO2 | 222108_at | −0.263 | GAGTAACTTCTTAAATCCCTGTTCT | SEQ ID NO. 819 |
| SPTBN1 | 212071_s_at | −0.261 | GTGCTCAGTCGTACGACCTGTACCT | SEQ ID NO. 820 |
| FHL1 | 201540_at | −0.26 | CAGGGCTGTCATCAACATGGATATG | SEQ ID NO. 821 |
| TUBB3 | 213476_x_at | −0.26 | GTGAAGGTGGCCGTGTGTGACATCC | SEQ ID NO. 822 |
| MGAT1 | 201126_s_at | −0.258 | TGAAGGGGCAAGCAAGACCTCTCC | SEQ ID NO. 823 |
| KIF2C | 209408_at | −0.257 | AGTGACATGGGACACTCCTTTTCTG | SEQ ID NO. 824 |
| SLC20A1 | 201920_at | −0.256 | AGAGCATGCTCTGCGTTGTTGGTTT | SEQ ID NO. 825 |
| TSPAN4 | 209263_x_at | −0.256 | ATATTTACGTATTCTCCAAAGCAGT | SEQ ID NO. 826 |

In some aspects of the invention, one or more biomarkers of sensitivity and/or resistance to oxaliplatin are measured in a biological sample obtained from a subject (e.g., a subject suffering from or susceptible to a disease, disorder, or condition treatable with oxaliplatin, such as cancer, e.g., colon cancer) using, e.g., a microarray, sequencing, NanoString, a protein array, or PCR-based methods, such as those described herein. In certain embodiments, the microarray includes probes capable of recognizing the one or more biomarkers of sensitivity and/or resistance to oxaliplatin, such as probes at least about 15 nt in length that have, e.g., a sequence with at least 5 (e.g., at least 10) contiguous nucleotides that are complementary to or identical to the sequence(s) of the biomarker(s). In embodiments of any of the above aspects, any one of the biomarkers from Tables 5 and 6 can be used to assess a subject's sensitivity and/or resistance to treatment with oxaliplatin. Alternatively, a combination of any of the biomarkers of Tables 5 and 6 may be used. For example, combinations that include the top 5, 10, 15, or 20 biomarkers from Tables 5 and/or 6 may be used. In some embodiments, one or more biomarkers of sensitivity to oxaliplatin is selected from the group consisting of MRPL16, ANP32A, SRSF2, PDSS1, PRIM1, HNRNPA1, NDUFAB1, GLTSCR2, RNPS1, and ICAM2. In certain embodiments, the biomarkers include MRPL16 and one or more of the biomarkers selected from the group consisting of ANP32A, SRSF2, PDSS1, PRIM1, HNRNPA1, NDUFAB1, GLTSCR2, RNPS1, and ICAM2 (preferably ANP32A, SRSF2, PDSS1, and/or PRIM1). In some embodiments, one or more biomarkers of resistance to oxaliplatin is selected from the group consisting of LPP, RHOC, CAPN2, FLNA, WDR1, FLNA, ACTN1, CNN3, FLNA, and ACTN1 (preferably LPP, RHOC, CAPN2, FLNA, and/or WDR1). In particular embodiments, one or more biomarkers of resistance includes LPP.

Furthermore, a combination of any of the biomarkers of Tables 1, 2, 5, and 6 can be used to assess a subject's sensitivity and/or resistance to treatment with the combination of 5-FU and oxaliplatin, and a combination of any of the biomarkers of Tables 3-6 can be used to assess a subject's sensitivity and/or resistance to treatment with the combination of irinotecan and oxaliplatin. In some embodiments, a subject's sensitivity to combination treatment with oxaliplatin and 5-FU is assessed by determining an expression level (e.g., mRNA or protein expression) of one or more biomarkers of sensitivity and/or resistance to 5-FU (e.g., the biomarkers shown in Tables 1 and 2, respectively), and one or more biomarkers of sensitivity and/or resistance to oxaliplatin. In certain embodiments, the one or more biomarkers of resistance to 5-FU are selected from the group consisting of NT5E, CNN3, ACTN1, FLNA, ATP2B4, CYR61, LGALS1, RHOC, RAB32, and TMEM158, and the biomarker of sensitivity to oxaliplatin is MRPL16. In particular embodiments, the biomarkers of resistance to 5-FU include NT5E, CNN3, ACTN1, FLNA, and/or ATP2B4. In one embodiment, the biomarker of resistance to 5-FU is NT5E.

Biomarker Expression Analysis Methods, Devices, and Kits

The methods, devices, and kits of the invention can be used to predict the responsiveness (e.g., sensitivity or resistance) of a subject to a target drug of interest based on the expression levels (e.g., mRNA expression level or protein expression level) of one or more biomarkers of sensitivity and/or resistance in a biological sample obtained from the subject. The biological sample can include, for example, cells, tissue (e.g., a tissue sample obtained by biopsy), blood, serum, plasma, urine, sputum, cerebrospinal fluid, lymph tissue or fluid, or pancreatic fluid. In certain embodiments, the biological sample is fresh frozen or formalin-fixed paraffin embedded (FFPE) tissue obtained from the subject, such as a tumor sample (e.g., a biopsy). Numerous methods of determining biomarker expression levels, or expression profiling, are known in the art, including, but not limited to, polymerase chain reaction (PCR), reverse transcriptase PCR (RT-PCR), quantitative real-time PCR (qPCR), Northern blots, Western blots, Southern blots, microarrays, NanoString nCounter technologies (e.g., those described in U.S.

Patent Application Nos. US 2011/0201515, US 2011/0229888, and US 2013/0017971, each of which is incorporated by reference in its entirety), next generation sequencing (e.g., RNA-Seq techniques), and proteomic techniques (e.g., mass spectrometry or protein arrays).

PCR-Based Techniques

Tissue or cell samples from mammals can be conveniently assayed for mRNA levels using Northern, dot blot or PCR analysis. For example, qPCR assays are well known in the art. In some embodiments, an mRNA corresponding to a biomarker of sensitivity or resistance can be detected in a biological sample by (a) producing cDNA from the sample by reverse transcription using at least one primer; (b) amplifying the cDNA so produced using a target polynucleotide as sense and antisense primers to amplify target cDNAs therein; and (c) detecting the presence of the amplified target cDNA using polynucleotide probes. In certain embodiments, primers and probes comprising the sequences described herein are used to detect expression of one or more genes, as described herein. In addition, such methods can include one or more steps that allow one to determine the levels of target mRNA in a biological sample (e.g., by simultaneously examining the levels a comparative control mRNA sequence of a "housekeeping" gene such as an actin family member or GAPDH). Optionally, the sequence of the amplified target cDNA can be determined. The primers for these assays may be labeled for detection according to methods known in the art.

Microarrays

Expression levels of biomarkers of sensitivity or resistance may be determined using high-throughput expression profiling platforms, such as microarrays. Microarray technology offers high resolution quantification of mRNA expression levels at a genomic or transcriptomic scale. In certain embodiments, a microarray for use in the methods of the invention for assessing the responsiveness of a subject to treatment with a target drug (e.g., 5-FU, oxaliplatin, and/or irinotecan, as well as analogs thereof, such as prodrugs, derivatives, metabolites, enantiomers, and combinations thereof) contains or is produced by generating oligonucleotide probes (e.g., DNA, cDNA, or RNA probes) capable of hybridizing to one or more biomarkers of sensitivity or resistance to a target drug of interest (e.g., one or more of the biomarkers of Tables 1-6) or their complement sequences (preferably the probe sequence is complementary to all or a portion of the biomarker sequence). For example, such biomarkers can include one or more (e.g., at least 5, 10, 15, or 20 or more (e.g., all)) 5-FU markers of Tables 1 and/or 2, one or more (e.g., at least 5, 10, 15, or 20 or more (e.g., all)) irinotecan markers of Tables 3 and/or 4, or one or more (e.g., at least 5, 10, 15, or 20 or more (e.g., all)) oxaliplatin markers of Tables 5 and/or 6. An oligonucleotide probe can be complementary or identical to a portion (e.g., at least 5, 10, 15, or 20 or more nucleic acid residues; preferably at least 15 contiguous nucleic acid residues) or the entirety of a biomarker sequence, or may have, e.g., about 75%, 80%, 85%, 90%, 95%, 99%, or 100% sequence identity to a sequence complementary or identical to a portion (e.g., at least 5, 10, 15, or 20 or more nucleic acid residues; preferably at least 15 contiguous nucleic acid residues) or the entirety of a biomarker sequence. A probe can have a length of, for example, about 5 nucleotides (nt), 10 nt, 15 nt, 20 nt, 25 nt, 30 nt, 50 nt, 75 nt, 100 nt, 150 nt, or 200 nt (preferably at least 15 nt). In certain embodiments, a probe is between 20-24 nt in length and/or has at least 85% sequence identity to a sequence complementary to a biomarker sequence. In other embodiments, a probe is between 20-24 nt in length and/or has at least 85% sequence identity to a sequence identical to a biomarker sequence.

In some embodiments, a microarray for use in the methods of assessing responsiveness to 5-FU includes probes about 15 nt in length, which are complementary to at least 5 contiguous nucleotides of the following biomarkers of resistance to 5-FU: NT5E, CNN3, ACTN1, FLNA, ATP2B4, CYR61, LGALS1, RHOC, RAB32, and TMEM158; and/or probes about 15 nt in length, which are complementary to at least 5 contiguous nucleotides of the following biomarkers of sensitivity to 5-FU: APRT, GSR, TUFM, MRPS2, MTHFD2, WDR59, ANP32B, PMM2, STOML2, and NDUFAB1. In certain embodiments, the biomarkers of resistance include NT5E, CNN3, ACTN1, FLNA, and ATP2B4; and/or the biomarkers of sensitivity include APRT, GSR, TUFM, MRPS2, and MTHFD2. In particular embodiments, the biomarker of resistance is NT5E.

In some embodiments, a microarray for use in the methods of assessing responsiveness to irinotecan includes probes about 15 nt in length, which are complementary to at least 5 contiguous nucleotides of the following biomarkers of resistance to irinotecan: CCND1, LGALS3, INPP4B, TMEM97, TCF7L2, SFN, LAPTM4B, LSR, SFN, and TMEM97; and/or probes about 15 nt in length, which are complementary to at least 5 contiguous nucleotides of the following biomarkers of sensitivity to irinotecan: PRF1, GZMB, PTPRC, PTPRC, PTPRCAP, PDE4DIP, ACAP1, PTPRC, S1PR1, and DOCK2. In certain embodiments, the biomarkers of resistance include: CCND1, LGALS3, INPP4B, TMEM97, and TCF7L2; and/or the biomarkers of sensitivity include: PRF1, GZMB, PTPRC, PTPRC, and PTPRCAP. In particular embodiments, the biomarker of sensitivity is PRF1.

In some embodiments, a microarray for use in the methods of assessing responsiveness to oxaliplatin includes probes about 15 nt in length, which are complementary to at least 5 contiguous nucleotides of the following biomarkers of resistance to oxaliplatin: LPP, RHOC, CAPN2, FLNA, WDR1, FLNA, ACTN1, CNN3, FLNA, and ACTN1; and/or probes about 15 nt in length, which are complementary to at least 5 contiguous nucleotides of the following biomarkers of sensitivity to oxaliplatin: MRPL16, ANP32A, SRSF2, PDSS1, PRIM1, HNRNPA1, NDUFAB1, GLTSCR2, RNPS1, and ICAM2. In certain embodiments, the biomarkers of resistance include: LPP, RHOC, CAPN2, FLNA, and WDR1. MRPL16, ANP32A, SRSF2, PDSS1, and PRIM1. In particular embodiments, the biomarker of sensitivity is MRPL16. In some embodiments, a microarray for predicting responsiveness (e.g., sensitivity) of a subject to combination treatment with oxaliplatin and 5-FU includes probes about 15 nt in length, which are complementary to at least 5 contiguous nucleotides of one or more biomarkers of resistance to 5-FU selected from the biomarkers of Table 2, and one or more probes about 15 nt in length, which are complementary to at least 5 contiguous nucleotides of MRPL16. In certain embodiments, the biomarkers of resistance to 5-FU are NT5E, CNN3, ACTN1, FLNA, ATP2B4, CYR61, LGALS1, RHOC, RAB32, and TMEM158. In particular embodiments, the biomarkers of resistance to 5-FU are NT5E, CNN3, ACTN1, FLNA, and ATP2B4. In one embodiment, the biomarker of resistance to 5-FU is NT5E.

In certain embodiments, a probe is single-stranded or double-stranded. In some embodiments, a probe is labeled (e.g., detectably labeled with a fluorescent molecule, dye molecule, small molecule, epitope tag, barcode sequence, polypeptide, or any other detectable molecule). Probes can be detectably labeled and immobilized on a solid support to form a microarray. Probes can be either prefabricated and spotted to the surface or directly synthesized on to the surface (in situ). The microarray can be configured such that the sequence and position of each member of the array is known. For example, a selection of genes whose expression correlate with the presence of a disease (e.g., colon cancer), an increased likelihood of developing the disease, or increased severity of the disease can be arrayed on a solid support. Hybridization of a labeled probe with a particular target nucleic acid (e.g., an mRNA corresponding to a biomarker of responsiveness (e.g., sensitivity and/or resistance) to a target drug) indicates that the sample from which the mRNA was derived expresses that gene (e.g., the biomarker of responsiveness to the target drug).

Differential gene expression analysis of disease tissue can provide valuable information. Microarray technology utilizes nucleic acid hybridization techniques and computing technology to evaluate the mRNA expression profile of thousands of genes within a single experiment (see, e.g., PCT Publication WO 01/75166; U.S. Pat. Nos. 5,700,637; 5,445,934; 5,807,522; Lockart, Nat. Biotechnol. 14: 1675-1680, 1996; and Cheung et al., Nat. Genet. 21(Suppl): 15-19, 1999). Thousands of genes are typically represented in a single array. In some embodiments, a microarray assay for determining the expression level of one or more biomarkers of drug responsiveness involves the following steps: 1) preparation of fluorescently labeled target from RNA isolated from a sample, 2) hybridization of the labeled target to the microarray, 3) washing and scanning of the array, 4) analysis of the scanned image and 5) generation of gene expression profiles. Commercially available microarray systems can be used, such as an Affymetric array (e.g., an Affymetrix GeneChip® system) or an Almac array. Details of various microarray methods can be found in the literature. See, for example, U.S. Pat. No. 6,232,068 and Pollack et al., Nat. Genet. 23: 41-46, 1999. In alternate embodiments, a protein array can be used to measure the protein expression level of one or more biomarkers of responsiveness (e.g., sensitivity and/or resistance) to a target drug (e.g., 5-FU, irinotecan, and oxaliplatin), such as one or more of the biomarkers listed in Tables 1-6.

Exemplary probe sequences suitable for use in the methods of the invention are provided in Tables 7-12 below.

TABLE 7

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| ALG5 | ADXCRIH.469.C1_at | TTCTAAATGAGCTCGAGATCCACATGCTATAGCCATTTGATTAGGCCAAGGCTGTAGATCATT TAGCCCCTTTTCTAATTTCTCAACATCTGGAAACTTTGTGGCTCCATCAGCATCTGCCATAAG GATCTTTTCTCCTCGAGAACTGAATATACCCATTCTAATCGCTCCACCTTTTTCACGATTCTT CACCAGGGTTATCACACGTACTTTGTCACTTTCATATTTCTGGCAATTTTTAAAAGCTACCTT TGAGGTCTGATCT | SEQ ID NO: 1166 |
| ALG5 | ADXCRIHRC.469.C1_s_at | GTTCTAAATTAGTTCCATTCTGGAGCTGGCTACAAATGGGTAAAGACCTACTTTTTATACGAC TTCGATATTTGACTGGTGCCTGGAGGCTTGAGCAAACTCGGAAAATGAATTAGGTTGTTTGCA | SEQ ID NO: 1313 |
| ALG5 | ADXCRSS.Hs#S11048289_at | GAATTTTAACATAACGCATGCCCCTTATATTTAGCTCTATTTAAGCAAAATTTAGTGTCCTCT TAGTATGATTAGGCTTCTCAAAGTTGTACATATTCTGAACTTTTCAATAAACCTTTAAAAGAT TTTTAATGTCAACTTTTTTAAAATCAGTTTCTAAAAATGAGATATTCTCATTGAAAATAAATA TTTTTATTAGTGATATTTAAATATTGAAAAACTATCTCTGCTTTTTCCCTCAGAATCAAATGG CTATA | SEQ ID NO: 2082 |
| ANK3 | ADXCRAG_NM_001149_s_at | GGCAGCACGCTGTAAAATTATTACTGTATTGTGTACTGGCTATAAGATGTAGACACCTTTCAG TAAGCCAATCATTTGTAACCATTCTAGCAGTGTCATATTAGGTTAATAAGGCTGCTGTGTTTT AAAGGGCATTTTTATTTGGGTTTTGGTGAAATTCTTTAATTTGTTGATTATATTCACATAAAA TCAGCATTCATTGACACATAGCTCTAATGACATATGTATGAAAACCATACACTGGATGACCT AGTCGATTATTTAAGCA | SEQ ID NO: 1008 |
| ANK3 | ADXCRSS.Hs#S1861798_at | AAAATGAATCTACTGCCTCCTCCGAAGCTAGTCCTTCAGATACTAGAAGACAATTATGCCCTC TTTATCAAAGGCCCTACTTAAACCAGTTCAGTGATAATCTATCTTCTATACCCGTTTTTCATA AATAGAACCATGTGTTGTTTCTTGCATAATTATAGAAGTGTTCAAGAGAAACGAAGAGAGTGA GTGGCAGGACCATGGTGTGATGCAGGAGGAAGAGCTCTTGGCTAGAATCTGCTCCCAACTCTC CAACTAACTGTGAATCATTGAATTGTTACTTAATGCCTCTATAA | SEQ ID NO: 2097 |
| ANK3 | ADXCRPD.11257.C1_at | ATTTCCTCAATCTAAGCCTCTGGTTTTAAGACACCTTTGACACTGGTTGTTGTTTCTGCACGT GTTTTCAGAGCGGGCTAACACCACTGCATGTAGCTGCACATTACGATAATCAGAAAGTGGCCC TTCTGCTTTTGGACCAAGGAGCCTCACCTCACGCAGCCGCAAAGGTACCTATAATTCCACAGC CTAAGGAGACTGATGGGTAAGGTCTATCAGTCTCTATCTGCACATCTACTTCTGCTTCAGCAG GAGCACCCTCCTAGTTTAGCCACGACATGCCGG | SEQ ID NO: 2298 |
| ANK3 | ADXCRAD_BX092880_at | TGTGAATGAGCAAAGATTCTGTCTTGGTGACACAGTAGTTCATATCAAATGAAATGTTTAATT GAAACCTTAGAAACTGTAACAAGGTATGAGGCACGATAAAGAAGAAAGAGAATGAAAGAATTA AAAGGCTTCCTTCTCAGTCTCAAATTCCTACTGCCTTAAGAATTTTTAAATTAAAACCAGTTC TTCATAAGCAATCAGTGGCTGAGAATTTGAGGTTATAACCTGGCATGGATATATGTGACACA | SEQ ID NO: 2582 |
| ANP32A | ADXCRPAGD.232.C2_s_at | CTTCATTTTTGTTACCTGATAGAATAGCTTTTCTTATGAGATATATATAATGTGATACTATGT TTGGATATTTTTGGTCTTAAAGCAAGACTCAGTGGTGTATCTTCATTAAAAGCTTCCTTTAAA AAAGTTACAGAGTTACTAAAAAAACAAGTACCCAAACAATCAAGTTGGGCCAACCTTGGAACC TTGTTTTGAATATCTTTCATTGTTTTGTTTGTCGTATTGTAAAAAGAATGTATGGTTGAAAAC TCAGGAA | SEQ ID NO: 1921 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| ANP32A | ADXCRAAD_AL547157_s_at | AAGAAGGTTATAACGATGGAGAGGTAGATGACGAGGAAGATGAAGAAGAGCTTGGTGAAGAAGAA | SEQ ID NO: 2357 |
| ANP32A | ADXCRAD_AL547157_x_at | GGAGGATGAAGAAGGTTATAACGATGGAGAGGTAGATGACGAGGAAGATGAAGAAGAGCTTGG TGAAGAAGAAAGGGGTCAGAAGCGAAAACGAGAACCTGAAGATGAGGGAGAAGATGATGACTA AGTGGATAACCTATTTTGAA | SEQ ID NO: 2358 |
| ANP32A | ADXCRAD_CN349881_s_at | TTGTAAATAGCAACCTAAAGGCGTATTTTGGCACTGGTCTGGGGACATTCCCCATCTCTCATC CCTTTTCCCCCTTCACAGATGGTGGTGGGCTTCGCTCTACAAAGAGGACTCTGATGTTACTCT TGAGCTTATGAGCCAGAGAGCTGAAAACCCAGGCTTGTTGTGTTAAGTTACAAGGAAAATGG ATTTGGTAATTAAAATTAGAAGAAACACACCTTCAAACTTCAACTTCTTTAAAAGAAAAAAAA AACTGTCCTATCTTGTTCTGTAAAATATTAGAACGCTTTGT | SEQ ID NO: 2736 |
| ANP32A | ADXCRAD_T67821_at | TTTAATGAAGATACACCACTGAGTCTTGCTTTAAGACCAAAAATATCCAAACATAGTATCACA TTATATATATCTCATANGAAAAGCTATTCTATCAGGNAACAAAAATGAAGCTTCCCCCTCACC TAGCAGTTCATCTGGGAATGCATCTTGGAAAAGATCCAATGGCCTGTTGGACTCAAAGAAGCC ATCCCCAAAAAAATTGTATAAAAGGGTTTATTGAAATTTATCCAATGACCAACCGG | SEQ ID NO: 2799 |
| ANP32A | ADXCRAAD_T67821_x_at | TTTAATGAAGATACACCACTGAGTCTTGCTTTAAGACCAAAAATATCCAAACATAGTATCACA TTATATATATCTCATANGAAAAGCTATTCTATCAGGNAACAAAAATGAAGCTTCCCCCTCACC TAGCAGTTCATCTGGGAATGCATCTTGGAAAAGATCCAATGGCCTGTTGGACTCAAAGAAGCC ATCCCCAAAAAAATTGTATAAAAGGGTTTATTGAAATTTATCCAATGACCAACCGG | SEQ ID NO: 2800 |
| ANP32B | ADXCRIH.2787.C1_s_at | ACATTCCGCCTTCCTTCCATGTAGTCCCTCTTGGTAATCTACCACCAAGCTTGTGGACTTCAC TCCAACAAAATTGTAAGCGTTGTTAGGTTTTTGTGTAAGATTCTTGCTGTAGCGTGGATAGCT GTGATTGGTGAGTCAACCGTCGTGGCTACCAGTTACACTGAGATTGTAACAGCATTTTTACT TTCT | SEQ ID NO: 1143 |
| APRT | ADXCRIH.1533.C1_s_at | GTGGAGCTGACCTCGCTTAAGGGCAGGGAGAAGCTGGCACCTGTACCCTTCTTCTCTCTCCTG CAGTATGAGTGACCACA | SEQ ID NO: 1201 |
| ATHL1 | ADXCRIH.1963.C1_s_at | GATGTTCGCAGGAAAAATCTGGAGATTTACGAGGCTGTGACGTCCCCCCAGGGCCCCGCCATG ACCTGGAGCATGTTTGCTGTGGGCTGGATGGAGCTGAAGGACGCAGTGCGGGCCCGGGGCCTC CTGGACAGGAGCTTTGCCAACATGGCTGAACCCTTCAAGGTGTGGACGGAGAATGCAGACGGG TCAGCGCTGTGAACTTCCTGACAGGCATGGGGGGCTTCCTGCAGGCGGTGGTCTTCGGGTGCA CGGGGGTTCAGGGTCACCCGAGCGGGTGTGACCTTTGAC | SEQ ID NO: 1222 |
| ATHL1 | ADXCRAD_AJ708476_s_at | AGTGGGATGGCTCTCTTCCCTCAGCCACGCCGCTTGTGAGGACAGAGGTGGGGGAGTGGGAAG TGGGAAGTCACCAGAGAACAGGAGAGGGATTTGAGGGCGCGACCCCAGCGCTCTCCACGGACC AGCCAGAGGGACTGGAGCCAGGTGTGCATGGGTTCAAGGCCCTGGCCCTGCCCAGCCTCTGTC TTGGGAGCTCAGCCCCAGGGTTCGGTCGTCAGCAGTTTCCCAAGAACAAGATGTGATGGCATC TGCTGCTGAAACCCTGATGAGGACCAGGCCCC | SEQ ID NO: 1756 |
| ATIC | ADXCRAD_BU189824_at | TCTTCCCTTTCCGAGATAACGTAGACAGAGCTAAAAGGAGTGGTGTGGCGTACATTGCGGCTC CCTCCGGTTCTGCTGCTGACAAAGTTGTGATTGAGGCCTGCGACGAACTGGGAATCATCCTCG CTCATACGAACCTTCGGCTCTTCCACCACTGATTTTACCACACACTGTTTTTTGGCTTGCTTA TGTGTAGGTGAACAGTCACGCCTGAAACTTTGAGGATAACTTT | SEQ ID NO: 2723 |
| CALML4 | ADXCRAG_NM_033429_s_at | TACAAACTGACATTGTCTACTATACATTTTTAAAAGCCATTTTACTGGTTTGGCATGCGGTAT GGAAATTCTAAGAGAGAAAGTTTTAAGGCAATGAATCACAGATTTAAGTTCATGGAATTTATG GTAACTTTATCTGTTTATGTACATTTTTCCCCTTTGTTAAACAATTAACAGCAGCACACTCTGG GACCACCAGCTATTTTCCCTCTCTTTCTGAAATCTAAGCTTTGT | SEQ ID NO: 1048 |
| CALML4 | RDCR490_C03_at | GGGAGCAGCACGAACTCCTGAAGACTTGGGAGCGTCAGCAGCTTCTGCGGAAGGGGTGGGGCT GAGGGTGGAGAGAGGAAGGGAAGGAAGAAAAGGGGAGCCTTCCTGGCCAGGGTAACCGGCACT AAGAGGCCTCACTCCAAGCCCCCGAGGAGCCTGTGGTGGGGCTGGAGACCCGGGCTCAGCCCC TCCACCACCCTTAAAGTCCTCAGAAGGTGGGAACTGAACTGGGCACAGGCTGGGAAACCGGCT GTGCGCTGGGCACTTGGAT | SEQ ID NO: 1373 |
| CALML | RDCR490_C03_x_at | GAGCAGCACGAACTCCTGAAGACTTGGGAGCGTCAGCAGCTTCTGCGGAAGGGGTGGGGCTGA GGGTGGAGAGAGGAAGGGAAGGAAGAAAAGGGGAGCCTTCCTGGCCAGGGTAACCGGCACTAA GAGGCCTCACTCCAAGCCCCCGAGGAGCCTGTGGTGGGGCTGGAGACCCGGGCTCAGCCCCTC CACCACCCTTAAAGTCCTCAGAAGGTGGGAACTGAACTGGGCACAGGCTGGGAAACCGGCTGT GCGCTGGGCACTTGGATTTTGCCAGCTGC | SEQ ID NO: 1374 |
| CALML4 | ADXCRAD_BX431388_s_at | GAAGCAGATATCGAACCCAATGGCAAAGTGAAGTATGATGAATTTATCCACAAGATCACCCTT CCTGGACGGGACTATTGAAGGAGGAGAATGGGAGAGCCTCCCCTGGGCCTGAAAACTTGGAGC AATTAATTTTTTTAAAAAGTGTTCTTTTCACTTGGGAGAGATGGCAAACACAGTGGCAAGAC AACATTACCCAACTATAGAAGAGAGGCTAACTAGCAACAATAATAGATGATTTCAGCCATGGT ATGAGTAGATCTTTAA | SEQ ID NO: 1753 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| CALML4A | ADXCRSS.Hs#S2988186_at | ACGTCTTTCCCGCTCACTGTAGCTGCCACCCATTCTTTTTAATCCCCAGAGAGCATACAGATG AGCCCCAGTGGGCCATCTCAGCCACATAGGGGACAGGCCGGGGAGAGGATCTAGAGCTGGCCC AGGGAAGGAGGCCCTTTTCATTTTGAGGGAGGCCTCCCATCAGAGAAGGGTCCAGTCCTGCCC CGACCCTGTCCTTCCCATGATACCCACAATCCCAGGGTGACCTGTCTCCAGGGCAGAAGTGAC AGACGAGGGCTAGGAGACTGGCTGAGGCCTAAGTCCTCTGCAAT | SEQ ID NO: 2163 |
| CALML4 | ADXCRAD_BQ928122_at | CTGGCCTGCAGGAAAGGAGCGCCCAGCTGCGCGCCTGGGCCGCCCGTCGCTCCCAGTGCTGCC GCCCTCGCGTTGCCTCCATGGCTGCCCCGCAGGCCCCTCGGCCCTGCCTTTTCCGAGGAAAAA CGGTTCAGCTCGGTG | SEQ ID NO: 2341 |
| CALML4 | ADXCRAD_BQ928122_x_at | AGGTCGAGGTGGAAGGGAGCCGTGCGGGCAGCCTCATCAGCGCTCACAGAGCCATGCCTGGCC TGCAGGAAAGGAGCGCCCAGCTGCGCGCCTGGGCCGCCCGTCGCTCCCAGTGCTGCCGCCCTC GCGTTGCCTCCATGGCTGCCCCGCAGGCCCCTCGGCCCTGCCTTTTCCGAGGAAAAACGGTTC AGCTCGGTG | SEQ ID NO: 2342 |
| CALML4 | ADXCRAD_AI348378_at | AGATCTTGAAAGTTTTATGTGTTTAAAATTGAAATTGTCTAAAAAAATGCTCTTTCCACATTA ATTTAGTTAGGATATATTTTCACTCCATTTCAGACACTTGACTCA | SEQ ID NO: 2835 |
| CALML4 | ADXCRAD_AW025529_at | ACCGCAGGTCGGACGCCATGACGTAACCTTTCTTCTCCTTGTCCACCATCAACATGGCTAGAA GAATTTCTTTCTTTGGGTCTTCTTGTTTTATTTGCATGTGCATAATGGTCAGAAAAGTGGAGA AATCCAGCTCTCCATTTCCGTCTATCCCGTGGGTCTGCAGGTGCCGCTGCACCTCCCCTGGCG TTGGGCTGGCCCCCAGGCACCTCATGGCCACCATGAGGTCGGGGGCTTTATCTTCCCCCTCTG CTGCTGTCATACAAGGAGAAGCATTTCTTGTCTCATTAATTT | SEQ ID NO: 2902 |
| CASP7 | ADXCRPD.1914.C1_at | GATAGTCTATGTATGTGTAAAACAATCTGTTTTGGCTTTATGTGCAAAATCTGTTATAGCTTT AAAATATATCTGGAACTTTTTAGATTATTCCAAGCCTTATTTTGAGTAAATATTTGTTACTTT TAGTTCTATAAGTGAGGAAGAGTTTATGGCAAAGATTTTTGGCACTTTGTTTTCAAGATGGTG TTATCTTTTGAATTCTTGATAAATGACTGTTTTTTTTCTGCCTAATAGTAACTGGTTAAAA | SEQ ID NO: 1529 |
| CASP7 | ADXCRPD.1914.C1_x_at | GATAGTCTATGTATGTGTAAAACAATCTGTTTTGGCTTTATGTGCAAAATCTGTTATAGCTTT AAAATATATCTGGAACTTTTTAGATTATTCCAAGCCTTATTTTGAGTAAATATTTGTTACTTT TAGTTCTATAAGTGAGGAAGAGTTTATGGCAAAGATTTTTGGCACTTTGTTTTCAAGATGGTG TTATCTTTTGAATTCTTGATAAATGACTGTTTTTTTTCTGCCTAATAGTAACTGGTTA | SEQ ID NO: 1530 |
| CASP7 | ADXCRSS.Hs#S3017613_at | GTGAATATGCTTACATCCCAGAGACTACATATATGGCAACAAAGAAAACAAAGTCCTGGCCCT CAGGGAGCTTCTAATCCAGTAACCACAATTTGGTGGTATGTTCACGGCATACAAGAAACAGTG GAAGGTCTGTCAAGGTTTACAACAATGAAAATTTCCCCTAAATTCCTAGCAGGTCGCAAAGT GCTCATACGCAATTCAAAAGCAGCGACAACCTGGGGTATTAGGCTCTCTTTCTATGTCAGCAG GGATGCCCACATGGCAGATGCCCAA | SEQ ID NO: 2181 |
| CCT3 | ADXCRIH.1715.C1_at | AGCTCTGTGAGGACATTATCCAACTGAAGCCCGATGTGGTCATCACTGAAAAGGGCATCTCAG ATTTAGCTCAGCACTACCTTATGCGGGCCAATATCACAGCCCATCCGCAGAGTCCGGAAGACA GACAATAATCGCATTGCTAGAGCCTGTGGGGCCCCGGATAGTCGCCGACCAGAGGAACTGA | SEQ ID NO: 1125 |
| CCT3 | ADXCRIH.2536.C1_at | AGGAATGACCTCTAGGGCCTGGGCAACAGCCCTGTATGGCCATTGTTCCACACCAGTCATGGC CTTGGATTTTTCTGTCAAGGCATGGGCCACAGCCATCTCGGAGGCCCCACCCCCTGGCACCAG CTGAGGGTCCAGGAAACATTGCGACACACTTGCATGGCATCCTGAAGGTTGCGTTCTACTTCC GAGAAAATCTCTTTGCTA | SEQ ID NO: 1209 |
| CCT3 | ADXCRIRC.2536.C1_at | HAGAAAGGCGATGACCAGAGCCGGCAAGGCGGGGCTCCTGATGCTGGCCAGGAGTGAGTGCTA GGCAAGGCTACTTCAATGCACAGAACCAGGCAGAGTTTCCCTTTTCCTGAGCCAGAGTGCCAG GAACACTGTGGACGTCTTTGTTCAGAAGGGATCAGGTTGGGGGGCAGCCCCCAGTCCCTTTCT GTCCCAGCTCAGTTTTCCAAAAGACACTGACATGTAATTTTTCTC | SEQ ID NO: 1321 |
| CLDN3 | ADXCRIH.1252.C1_at | TGCAGCCTTGCCTCGGAGGCCAGCCCACCCCCAGAAGCCAGGAAGCCCCCGCGCTGGACTGGG GCAGCTTCCCCAGCAGCCACGGCTTTGCGGGCCGGGCAGTCGACTTCGGGGCCCAGGGACCAA CCTGCATGGACTGTGAAACCTCACCCTTCTGGAGCACGGGGCCTGGGTGACCGCCAATACTTG ACCACCCCGTCGAGCCCCATCGGGCCGCTGCCCCCATGCTCGCGCTGGGCAGGGACCGG | SEQ ID NO: 2231 |
| CNOT1 | ADXCRIH.3349.C1_at | TTCCAGACAAAGGTTTTCTCTTTCATGTATTTACACAAGTTCAAAATGATATTCACAGCATCT TCTAAATTTTGGCCAAGAGTCAAAAAAATGCATTTAAACTTTGGAACGTGCCCACATAAGACA GGAGGCTGATCCCAACAGTAGTTGGGGCAGATACCCACAAACAAAGGGCTGGGAAAGTCAGG AAGAGTTGAAAGGATTCTTCAGTCAGTTTATGAACTCGGTGCAGTGAGACCTCTAGACTGACA CGTACAACAGAGATGCAGTTTCGTCTAACTGGCACCTGTCCCTTCGGA | SEQ ID NO: 1129 |
| CNOT1 | ADXCRIH.2766.C1_at | TTTGTTGACAGATGCACCACCAGGGAATACTGACACCGATGATCTCATACCAAGGT | SEQ ID NO: 1137 |
| CNOT1 | ADXCRIH.2766.C1_s_at | GATTGCCCCAGCTGATGGAAGTAGTGCGATCCAACTATGAAGCAATGATTGATCGTGCTCATG GAGGCCCAAACTTTATGATGCAT | SEQ ID NO: 1138 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| CNOT1 | ADXCRIH.2766.C1_x_at | GATTGCCCCAGCTGATGGAAGTAGTGCGATCCAACTATGAAGCAATGATTGATCGTGCTCATG GAGGCCCAAACTTTATGATGCATTCTGGGATCTCTCAAGCCTCAGAGTATGATGACCCTCCCA GGCCTGAGGGAGAAGGCAGAGTATCTTCTGAGGGAATGGGTGAATCTCTACCATTTCAGCAGC AGCTGGCCGCGACAGTACCAAAGCTTTCTCTGCATTTGTTGACAGATGCACCACCAGGGAATA CTGACACCGATGATCTCATACCAAGGT | SEQ ID NO: 1139 |
| CNOT1 | ADXCRIHRC.3349.C1_s_at | TAGGAAAGGGAACCAAATCTCATTAATTAATTGTTCTCCCCCATTACCCCACTGAATGAATGG CCATACAGGCTAAGCTGAATAATGACAAAGTTGAAAGGACCAATACAGCCCCTTTTATAAGGA TTTTGAATGTTTTGCAAATGTATTGGTCCCTGTGTTGTATTTTGTAGCCTTTTCCTGGGCTTC AGCTCCCCTACTTCTTGTATGTGTATGCATACTGTAGCTAACCATTAAAGTCATG | SEQ ID NO: 1309 |
| CNOT1 | ADXCRPD.235.C1_at | CCGGGACCACTGCAAACTGTCCGTATCCCTTTCCCTCCCCACAGAAAAACCCCGCGCCCAAAA ATCGGCCCTGTGCTGTCCC | SEQ ID NO: 1502 |
| CNOT1 | ADXCRPD.6310.C1_s_at | AGCTCCTGGCTTTGTATATGCCTGGCTTGAACTGATTTCCCATCGGATATTTATTGCAAGAAT GCTGGCACATACGCCACAGCAGAAGGGGTGGCCTATGTATGCACAGCTACTGATTGATCTTAT TCAAATATTTAGCGCCTTTCCTTAGAAATGTGGAACTCACCAAACCTATGCAAATCCTCTACA AGGGCACTTCAAGAGTGCTGCTGGTTCTTTTGCATGAT | SEQ ID NO: 1741 |
| CNOT1 | ADXCRPD.12126.C1_at | GGCCTGTCTGCAAGCATTAATGCAGGAGTGTTTTTCACGGAGCTAACAGAAAACATCTTCCAC TGTGTAAGTC | SEQ ID NO: 2302 |
| CNOT1 | ADXCRPD.12126.C1_s_at | ACTCCATTTGCCTTTGTTATTGACCTTGCTGCACTTGCTTCACGTCGTGAATACCTCAAACTT GATAAGTGGCTCACAGATAAAATTCGAGAGCATGGGGAGCCTTTTATCCAGGCGTGTATGACT TTTTTAAAGAGACGGTGTCCTTCTATTTTGGGCGGACCTGCCCCAGAAAAAGACCAGCCCAAA AGTGCTCAACTTCCTCCAGAAACTTTGGCGACAATGTTGGCCTGT | SEQ ID NO: 2303 |
| CNOT1 | ADXCRPD.12126.C2_at | CATGTTTCTTCCTTTCTCGTTAGGAAGAGCTTGGATTTGATTGAATCTCTGCTGAGGCTTGCA GAGGTTGGGCAGTATGAGCAAGTCAAACAGCTCTTCAGCTTCCCTATCAAACACTGTCCAGAC ATGCTGGTATTGGCCTTACTACAAATTAACACCTCTCTGGCATACCTTGCGCCATGAACTTAT CTCCACTCTGATGCCAATTTTCCTTGGAACCATCCTAACTCAGCTATTATTTTGCACTATGCA TGGCATGGGCACGTAAGATGTGACACGTGGCATCTCTCAATACGG | SEQ ID NO: 2304 |
| CNOT1 | ADXCRPD.12126.C2_s_at | GCTTGGATTTGATTGAATCTCTGCTGAGGCTTGCAGAGGTTGGGCAGTATGAGCAAGTCAAAC AGCTCTTCAGCTTCCCTATCAAACACTGTCCAGACATGCTGGTATTGGCCTTACTACAAATTA ACACCTCTCTGGCATACCTTGCGCCATGAACTTATCTCCACTCTGATGCCAATTTTCCTTGGA ACCATCCTAACTCAGCTATTATTTTGCACTATGCATGGC | SEQ ID NO: 2305 |
| CNOT1 | ADXCRAD_NM_206999_at | GGCTATTTCCTTGGTATAGGTACAAAACGTATTACTGCTTGTCTGTAATAATTTTTTCTTTG TCTATATATGGCACTGGGCGTTACCACTTATTCTTAATAATCACCATATTTGTTTGATGTCTT CCATCATTTTAGATTGTAATTCTGTGAGGCAAAGCATCATGTCTGTGTGTTTTTTTTTTTTTC TGTTATATTCTCAACACGATGTTTGACAGATAGTAGATACCCAA | SEQ ID NO: 2757 |
| CYBA | ADXCRIH.1394.C1_s_at | ATTGCGAGCGGCATCTACCTACTGGCGGCTGTGCGTGGCGAGCAGTGGACGCCCATCGAGCCC AAGCCCCGGGAGCGGCCGCAGATCGGAGGCACCATCAAGCAGCCGCCCAGCAACCCCCCGCCG CGGCCCCCGGCCGAGGCCCGCAAGAAGCCCAGCGAGGAGGAGGCTGCGGTGGCGGCGGGGGGA CCCCGGGAGGTCCCCAGGTCAACCCCATCCCGGTGACCGACGAGGTCGTGTGACCTCGCCCC GGA | SEQ ID NO: 1119 |
| DDC | ADXCRAG_AY526322_at | GATTATTCAGACTAATCTGTGGTCAATACAGAGCATCTTTATTTAAATACATATTCAAGTTAG TGTCAAAAAGAGTGCACAAAGTGCTGCTGGCACTGGAATTAGATGTTTCCTTACTGACCTCTG GTATCTCCTGATAACAGGCCCCTCCTGCTTAGTGTTGGGAAAGTCCCAGATTGATCTAGACAC AACTAACAGCTGATATGAAAGATTTGTCCTGGAATCACATGTCTCC | SEQ ID NO: 910 |
| DDC | ADXCRAD_CD013938_s_at | GAGGGTTGTGATTTTGTCTGCTTAGTATCTCATCAACAAAGAAATATTATTTGCTAATTAAAA AGTTAATCTTCATGGCCATAGCTTTTATTCATTAGCTGTGATTTTTGTTGATTAAAACATTAT AGATTTTCATGTTCTTGCAGTCATCAGAAGTGGTAGGAAAGCCTCACTGATATATTTTCCAGG GCAATCAATGTTCACGCAACTTGAAATTATATCTGTGGTCTTCAAATTGTCTTTTGTCATGTG GCTAAATGCC | SEQ ID NO: 1005 |
| DUSP2 | ADXCRPD.6684.C1_s_at | AGCTGTGACAACCAGGAGCCCTGTCTGTGGGTTCGTCTGCCCAGGGCCTGGAGCCCAAGCCCT GTGTTCCTGGGGAAGCTGGGGACTTGGGAAGTGATGGGTGTGTCATGTTGCGTGTGTCTGTCT GTGAGCCTTTCACACCTGTGCTGGCGCTGGAAAATTATTTGTGCTCAGCTGACATTTAACACT CCCTCCCCCGCTTCCTCCTAGCCCTGTGGGCAGGGGTTGGAAACTTAGCACTTTATATTTATA | SEQ ID NO: 1779 |
| EEF1B2 | ADXCRIH.572.C1_s_at | TAGATGTGAAACCTTGGGATGATGAGACAGATATGGCGAAATTAGAGGAGTGCGTCAGAAGCA TTCAAGCAGACGGCTTAGTCTGGGGCTCATCTAAACTAGTTCCAGTGGGATACGGAATTAAGA AACTTCAAATACAGTGTGTAGTTGAAGATGATAAAGTTGGAACAGATATGCTGGAGGAGCAGA TCACTGCTTTTGAGGACTATGTGCAGTCCATGGATGTGGCTGCTTTCAACAAGATCTAAAATC CATCCTGG | SEQ ID NO: 2228 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| EEF1B2 | ADXCRIH.572.C3_at | GCTCTCGAAGTTTATCAGGATGTTCACATGACAAAACTGGACCCAGGCTACTTTAGTTTTGTT GGGATATTGTAAGCTAAATTTTTCTGTAACCTTAGAAGGCCAAGAGACTGAAGCCCTCCATTT TTTCACAGAACAGGTAGAACATGGACAGCAGCAATTCAACTTTTCCCCACACTGCCCTGCCAA TGTGCCTCGACCTTGACCTGGGGGGCCCACCTCTGGGGTGAGAGGGTGGCTCATTCATTCAGT CCTTGGCCATTCTTCTGAAACTGCCAACAAGGGTG | SEQ ID NO: 2229 |
| ETS2 | ADXCRAG_AL832032_at | CCCCCTTCAGTCGGCTCTCATTCTCCTTCCTGCTGCCCTGTGAAGAAGAACATATTTGCTTCC CCTTCTGCCATGAATGTAAGTTTCTTGAGGCGTCCCCAGCCATGCCAAACTGTG | SEQ ID NO: 893 |
| ETS2 | ADXCRIH.651.C1_s_at | GTATTTATCACTTGGACATCTGTTTATAATATAAACAGACATGTGACTGGGAACATCTTGCTG CCAAAAGAATCCTAGGCAGTGGCTCATTGTATGTGAGGTTGAACCACGTGAAATTGCCAATAT TAGGCTGGCTTTTATCTACAAAGAAGGAGTTTCATGGGGTTCAGCCTAACAGTTATGGAAACT ACAGTCCTTATAAACCATTGGCATG | SEQ ID NO: 1111 |
| ETS2 | ADXCRPD.8805.C1_at | ATTTGTCTGGCAAAATTAAGTTCTTTTTTCTTTAAAATGAACTTTTTTTCTTATTTCGAAGTG ATGTGTATGTAAAGAGGCAGTGTAGACTGGTGGTTAGGAGCACTCTGGAGTCAGAAGCCTGCT TCAGAATCTTGGCTACCTCACTTACCAAGGATAGAGCTGTGGGGAGTTTACTTGTTCTCACTC TCTCTTCTTTTTTCCATCTGTAAAATGGCAAAATAAACCACCTAAGTAAAATGGCCTCTGCG AGAGACCCATAAATTA | SEQ ID NO: 1449 |
| ETS2 | ADXCRPD.3556.C1_at | GGTAAGATATGGCTACAAACAGATCAAAACTTCCACTTCAAGATGCTAGAAAGAAGC | SEQ ID NO: 1597 |
| ETS2 | ADXCRPD.3844.C1_x_at | CAACTTTATTTTGACTACTTTGATAACTTAAATAATTCTTTGTTACAGTGTTACTTCGTATTA GAGAGAATGTTTTTATTCTCAGGCGATAGATGCAAAAATATTTAAAGTGCAGCTCACTTTCAA ACGGTTCAGCCAAATGTCGATGATTTTTGAATCTAAGTGGTGAGTATACAAATGTTCCTCGTA TTCATCTTTTTATCTTTTTTGTATATTTGAAAATTTTTGGAATACAAAGTTGGAAAAAATAAAT CATGCCCAAAAGATTGCCAGTAG | SEQ ID NO: 1655 |
| ETS2 | ADXCRSS.Hs#S1228156_at | ATTCTGCACATTTGGTTCTATGTCATTTGCCATAGTCTTAAGGACGTAGGTTCCATAATCATC CCTTATTCTGTAGAGGAGGCCCAAGGTTAGTGAGCAGAGGAAGGTTCCACTGTCGGGAACCGG TGGTCTTCAAACTCCTGTGCTCCTCTTTTGATATCTTTCTGCTCATATATGTTGGAAACAGCC CAGCATGAGCAAAGCACCACCTCCTAGCCCCCAGCCTGTGCCAGCCCTGCAAAGAGGAAATAT GGCTCCACTCAGGGAGCCCATCAGCGACTCAGGGA | SEQ ID NO: 2067 |
| ETS2 | ADXCRSS.Hs#S2874408_at | TTCCTCCTCAGCAACGGGCACAGGTCGTTCCAGTTTTGGCCAGGCGGTGGCGCTCGAGGCAAA CGGTGTCATGAAACGGTCACTGGATGCACTGACCCTGAAGATGCTCTCAAAGCACGAGTCCGT TCATCAGAGAGTGGACTTGACACCCATCAGAAACATTCCCGGAGTGCGTTGGTGTGAAGGTGC GAGGAGAGTCGGGGAAGCATCCCGAAGCCCTGCTAGGCGAATGGGTACTGCTGAGATTACAGG GTCAGCACAAAGCA | SEQ ID NO: 2072 |
| ETS2 | ADXCRSS.Hs#S3746017_at | CTCTTCTTATTTGAATACCCTTGACTTCCTCTCTTCCTATTTGAATACTCTTTCTTTCTCTTG CCTGATTGCTCTGGCCAGAACTTCCAGTACTGTGTTGAATAGGGGTGGTGAGAGAGAGCATCC TTGTCCTTGTGCCGGTTTTCAAAGGGAATGCTTTCTGCTTTTACTCATTCGGTATGATACTGT CTATGGAT | SEQ ID NO: 2200 |
| ETS2 | ADXCRSS.Hs#S3746017_x_at | ACAATTTGACCTTCTCTCTTCTTATTTGAATACCCTTGACTTCCTCTCTTCCTATTTGAATAC TCTTTCTTTCTCTTGCCTGATTGCTCTGGCCAGAACTTCCAGTACTGTGTTGAATAGGGGTGG TGAGAGAGAGCATCCTTGTCCTTGTGCCGGTTTTCAAAGGGAATGCTTTCTGCTTTTACTCAT TCGGTATGATACTGTCTATGGAT | SEQ ID NO: 2201 |
| ETS2 | ADXCRSS.Hs#S3736200_at | GGTTAATATCCATGCTATAAAGTTTTATTTTTTCATCAACAAAACTAATTGCATTGGCACTTT CAAAATGTTGTTTGCACATAAATGATTTATACTTAAGTATGAGTGTAACATCTTGCCATCAG GACCTGGTCTGTTGGGAGATATCAGTGAATGGAGCCTGGCTCTTCCAATGGGCAACCGTTGTT TGTTGGTGAAGCTGCCACCCTTGAGACCTGCCTGGTCTCCTTCCCACCTGTAGCTGGCTAAGT AGTGTCTCCCCACAATTCAC | SEQ ID NO: 2210 |
| ETS2 | ADXCRSS.Hs#S3738574_at | CTTGCTCTAAGAATTGCCTGGACTAGCACTAACAGTGCTGACCTATGGAAGATCGTGTGAGCC ACTTAAGCAACTGCGAAAGTTCTAGTGGCCATATTAAAAAAGCAAAAAAGAAACAGGTGAAGTT AATTTTCTTATTTTACTTGGCCTCATATAGCAATTATCATTTCAATATGTAATCAATACATTA AAAATTATCAGGGAGACATTTTATATTCTCTGTTTCATACTAAGACTTCCAAATCTGGTGTGC ATGACTATACTCTGCTTGTCCTG | SEQ ID NO: 2217 |
| ETS2 | ADXCRIH.2576.C1_s_at | GCAGGATTGAAAATGTCCAGGAAAGTGGCCAAGAAGCAGTGGCCTTATTGCATCCCAAACCAC GCCTCTTGACCGGCTGCCTCTCTTGTGGCAGCAACGGCACAGCTAATTCTACTCACAGTGCTT TTAAGTGAAAATGGTCGAGAAAGAGGCACCAGGAAGCCGTCCTGGCGCCTGGCAGTCCGTGGG ACGGGATGGGTTCTGGCTGTTTGAGATTCTCAAAGGAGCGAGCATGTCGTGGACACACACAGA CTATTTTTAGAT | SEQ ID NO: 2259 |
| ETS2 | ADXCRIH.2576.C2_at | ACAACCATGTCATTTCAGAAGTTAGTTTGTATATATTATAATAATCTTATAATTGTTCTCAGA ATCCCTTAACAGTTGTATTTAACAGAAATTGTATATTGTAATTTAAAATAATTATATAACTGT ATTTGAAATAAGAATTCAGACATCTGAGGTTTTATTTCATTTTTCAATAGCACATATGGAATT | SEQ ID NO: 2260 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| | | TTGCAAAGATTTAATCTGCCAAGGGGCCGACTAAGAGACGTTGTAAAGTATGTATTATTCACA TTTAATAGACTTACAGGGATAACGCCTGTTGG | |
| ETS2 | ADXCRAD_AI632259_x_at | CTCCTGCTTCAGCCTGGGAGGCAGAGCTTGCAGTGAGCCGAGATTGCGCCACTGCACTCCAGC CTGGGAGACAGAGCGAGACTCCGTCTCAAAAAAACAAAACAAAACAAACAAACAAACAAAAAA CAACAAAGCAATCAATACCAGANACATGAAAGAAAAATGCCAGTTCTCAGAGCTGTT | SEQ ID NO: 2831 |
| ETS2 | ADXCRAD_AV646177_at | TGTAACCATTCTCAGCTGTTACATTTCTGCTCTTTATCCTTTTTTTTTTTTTTTTGGTTTAA AAGCAGCGATCCATCAGCAACACCAAACTTGAAATTGATTTATGTGGAAAAACTTGGCTTGTC TGCCATCTAACAAGCCCTGTTGAGTAAAATAAGCAAGCTTAAATTTGATTAGTTGTGTGTCTG CCTGAAACCATTTAGTAGAGCACTTTAATTCTGCATGGTTTTTA | SEQ ID NO: 2847 |
| ETS2 | ADXCRAD_AK023838_x_at | GAGGTATCAGGGAACCGAGATCGCACCGCTGTACTCCAGCCTGGGCGACAGAACAAGACTTCG TCTCAAAAATATATCTATACAAGCACAAGGTT | SEQ ID NO: 2869 |
| FABP5 | ADXCRPD.277.C1_x_at | GTGTGTTGGATTAATTAGGATCATCCCTTTGGTTAATAAATAAATGTGTTTGTGCTAANNNNN NNNNNNNNNNNNNNNNNNNNNNNNNNNNNNNNCCNNNNNNNNNNNNNNNNNNNNNNNNNNNN NNAATATGTTCGGGCGCCTCGGGCCCTTCAAAAAACTTTTTCAAGAACCATTTCGTTTTGGC CCCCGCGGGCCCCAATAGGGTAAAGTGAAAACTTGGCCCATACCTTGTTTTCCCATAGGAAAA TCCCCTGGGCCATTGAACAAAGG | SEQ ID NO: 1504 |
| FASN | ADXCRAG_NM_004104_s_at | TACTGTAACTGTCAGTGTACACGTCTGGACCCCGTTTCATTTTTACACCAATTTGGTAAAAAT GCTGCTCTCAGCCT | SEQ ID NO: 1025 |
| FASN | ADXCRAD_BQ188744_s_at | ATTTCCCCGATGTCCCCTGCGGGCGCGGGCAGCCACCCAAGCCTGCTGGCTGCGGCCCCCTCT CGGCCAGGCATTGGCTCAGCCCGCTGAGTGGGGGGTCGTGGGCCAGTCCCCGAGGAGCTGGGC CCCTGCACAGGCACACAGGGCCCGGCCACACCCAGCGGCCCCCCGCACAGCCACCCGTGGGGT GCTGCCCTTATGCCCGGCGCCGGGCACCAACTCCATGTTTGGTGTTTG | SEQ ID NO: 2528 |
| FBXL14 | ADXCRPD.4724.C1_s_at | GGAGGAATAGATGACTTTCTTTCTTTTGGTGGGGGTTGGGACTTGTGGCTTTAAAGAAATCAC TTCTGAGTAGGATGTATATTTTCGTTGGATTTTTGTTGTTATTTCTTTAGAACCCTCCACAGC AACATGCAAGACCATGGAGTTAAAGAAACCCAGAGACCTTTATCAATTAATTGTACTGTTTGT GAAT | SEQ ID NO: 1696 |
| FBXL14 | ADXCRPD.10538.C2_at | AATCTCATTGGATTACTCCTCCTTACATTACTGCGTTTGGATTTGTAGTCTTAACAAGGCAAT AAATGGAAGGGGAAAGAAGGAATCAATTCATGGTAACTAGAATGTAATGAGCACTTGCATTAA GTCACAATTTAATTTGTATACTTTCGGAAATTCTTTCCTGGTTGTAAGCCTAAAGGGGCCTGC CTAG | SEQ ID NO: 2297 |
| GCLC | ADXCRAG_BC022487_s_at | AGCCTGACTGCTCTCAGTGCAAAGACCCAGAACCCAGCCTTCCTTCACCTGAAACAGCTGCAG CGTGCACACACACTTCTTGTGCATATATCTCTGGTCTATTTATTTTCAAAACTAAGTATAATC CAAATTGAATGCTGGAATCAGATTTTTCCATTCTGAATGTGTTTAAATAACATGGCCAAGGAT AATTTCTTTCTGTTTTCTTGACATTTATAGGTAGTATAAGATATGTGACTTCCAAATAAAC | SEQ ID NO: 948 |
| GCLC | ADXCRAD_CR738919_s_at | AAAAATGGCGTTCTTCTCTTGTGGCCTGTTATTCTGATTGCTGCTGTATACAGTTTTGTCACT CTTTAGTTTTTAGTTAAGCATACTGATAGACTTTTCCTCTAAAAGCCATTCACTCCAGATTTTA CCTGGGGAATATTCTACATACTGCTTACTTTCTCTATAAAACTCATCAATAAATCATGAAAGG CACTGAGTTTTGTAAATCAGGACCCTAAATGTTTAATTGTAAATAAGTTTCAGATAATTATTA TAGCTTTGCGTTGAAGTTTGTTGT | SEQ ID NO: 1010 |
| GCLC | ADXCRPD.5046.C1_s_at | ATAACTCTGTATTGTAGATTATGCAGATCTTTACAGGCATAAATATTTAAACTGTAATATGCT AACTTGAAGAGATTGCAATAAAGCTGCTTCAGCTAACCCTGTTTATGTTTAAATACTAGGGTT TGTTCTATATTTTATACATGCATTTTGGATGATTAAAGAATGCCTGGTTTTCGTTTGCAATTT GCTTGTGTAAATCAGGTTGTAAAAGGCAGATAAATTGAAATGTTTGTGGTATGAGGAA | SEQ ID NO: 1638 |
| GCLC | ADXCRPD.8360.C1_s_at | GTAATTGTACAATACTTGCATTCCAGAGTTAAAATGTTTACTGTAAATTTTTGTTCTTTTAAA GACTACCTGGGACCTGATTTATTGAAATTTTTCTCTTTAAAAACATTTTCTCTCGTTAATTTT CCTTTGTCATTTCCTTTGTTGTCTACATTAAATCAAATGAATCCATTGAAAGTGCTTCAAGGG TAATCTTGGGTTTCTAGCCCCTTATCTATGATGTTTCTTTTGCAA | SEQ ID NO: 1851 |
| GCN1L1 | ADXCRAG_U88837_s_at | TGATACTGCCCACCATACAGAAGTCCTTACTGAGGAGTCCAGAGAATGTTATTGAAACTATTT CTAGTCTGCTGGCATCAGTGACGCTTGACCTCAGCCAGTATGCCATGGACATCGTGAAAGGAC TGGCTGGTCACCTGAAATCCAACAGTCCCCGCCTGATGGATGAAGCTGTGCTGGCACTGCGGA ACCTGGCACGCCAGTGCAGTGACTCTTCGGCCATGGAGTCCCTGACCAAGCACCTATTTGCTA TCCTCGGAGGCTCGGAAGGAAAACTAACTGTTGTAGCCCAGAA | SEQ ID NO: 1077 |
| GCN1L | ADXCRAG_XM_0457920_at | TAAAGGCTTTGATTTAATCTTGATATAAACAGATTTTTAAAAATCTCCACCCATTAAACATGA AGCTTCCTGCATCAGGAA | SEQ ID NO: 1085 |
| GCN1L1 | ADXCRAD_BU599568_s_at | TCTTCTCCTGTGCTTGAGCTCTGGTTTGAGAGCTGGCGCTACCAACCTTTTTCCTATATCCCG AGTGGGGCACAGACGGTGGATCTCTGCCCAGTGTGGTGTGTCTGGCTTGGCTTTTCAATATTG | SEQ ID NO: |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| | | TGAGGTCTGAATGGATCTGATCCCTGTCAGATGAAAATGATTCACAGCTCTGGCAGTTCCCAA GTCTGGGGAGGGGTATAGGTTTGAAAGGCTGTTTGAA | 1086 |
| GCN1L1 | ADXCRPD.13574.C1_at | AAGCCTTAGGTTGGTAATCCGGCTGAACTCGGCTTGACGGCCTGAGGCCC | SEQ ID NO: 1664 |
| GCN1L1 | ADXCRPD.13574.C1_s_at | GATGCCCTAAATGCCATCACTAAGAAGCTGGATGCTGGCAACCAGTTGGCACTCATTGAAGAG CTGCACAAGGAAATCCGGCTCATAGGGAACGAGAGCAAAGGCGAGCATGTGCCAGGATTCTGC CTCCCCGAAGAAGGGAGTGACCTCCATCCTTCCAGTGTTGCGGGAAGGAGTCCTGACTGGCAGC CCTGAGCAGAAGGAGGAGGCAGCCAAAGCCTTA | SEQ ID NO: 1665 |
| GCN1L | ADXCRAD_BQ890025_at | TCCAGTTTAGCCATGGCTAGGGTCCTGGAACTATAATAAGCAAGGGTCCAGACTGGTGGGGTT TCCTCCTTTCTCCTGTGGCTTGGAACCTCTTGGGTTTGAAAAGCTGGGCGCCTACCNAAACCC TTTTTTTTCCCTATAATCCCCGGAATTGGGGGGCAACAGAACGGTTGGGGAATCTCCTG | SEQ ID NO: 2576 |
| GCNT3 | ADXCRIH.1160.C1_s_at | GATCTTTTGCCTTGCAAATTGCTGCCTGGGTGAATGCTGCTTGTTCTCTCACCCCTAACCCTA GTAGTTCCTCCACTAACTTTCTCACTAAGTGAGAATGAGAACTGCTGTGATAGGGAGAGTGAA GGAGGGATATGTGGTAGAGCACTTGATTTCAGTTGAATGCCTGCTGGTAGCTTTTCCATTCTG TGGAGCTGCCGTTCCTAATAATTCCAGGTTTGGTAGCGTGGA | SEQ ID NO: 1183 |
| GCNT3 | ADXCRPD.15673.C1_at | GAAGGTCAGGACTTTGTGAACATATAAAACTGCAGATGGCTATTAGATATCCAAGTAGAGATG CTGAAGAGATGAATGTATATAGAAGTCTGAATTTGGGAGGAGAGTCTGGATAGGAGATACTTA CCTGGTGTTTAACAGCTTACAGATTGTGTAAAGTCATGAAACGGATAAGAACCTTAAAAGAGA GAAAAGGGAATAGAGGTTACCAAATGAATTGCAGTTTCCAAATTGCAGAG | SEQ ID NO: 1778 |
| GCNT3 | ADXCRSS.Hs#S1924358_at | GGTGTGAACCGCTGTATCCAGCCTCTTTTTCAACTAACATCTTATCTGAGGTATAATATCCGT ATGCAAAAATACAAAAATTCCAAATATCTAACTCAAGAATTTTACAAAGTGAGCACACCTGTG TAACTAGAACACTGGTCAAGAAAGAGAACATTCCCAGCAACCCAGAGTATCTCTTGTGTTCCT TTCCGATGGCTTTCCAAAAATAACCATTGTTCTCACTTCTAACATCACAGATTATTTTGCCTG TT | SEQ ID NO: 2112 |
| GCNT3 | ADXCRSS.Hs#S2978009_at | TACTCCTCATGGATCATACCTCGCTCTCCTCAGATGTTTTAATATATCCTTGAGATGGGGTCT TGCTGTGTCACCCAGGCTGAAGTATACTGAGTGGTACAATCATTGCTCACTGCTGGCCTTGAA CTCCTGAGATAGGAGGCGATCCCCCCATCTCAGCCTCCTAAAGTGCCGGGATTACAGACGTGA GCCATCGCATCCAGCCTGGAAGTATTTTGAAGGTTCAGTGTGAGGATTGCTGACAGATTGAG CTGGAG | SEQ ID NO: 2136 |
| GPX2 | ADXCRIH.789.C1_s_at | AGGAGCCTTAGGATGCAGCATGCCTTCAGGAGACACTGCTGGACCTCAGCATTCCCTTGATAT CAGTCCCCTTCACTGCAGAGCCTTGCCTTTCCCCTCTGCCTGTTTCCTTTTCCTCTCCCAACC CTCTGGTTGGTGATTCAACTTGGGCTCCAAGACTTGGGTAAGCTCTGGGCCTTCACAGAATGA TGGCACCTTCCTAAACCCTCATGGGTGGTGTCTGAGAGGCGTGAAGGGCCTGGAGCCACTCTG CTAGAAGA | SEQ ID NO: 1147 |
| GPX2 | ADXCRPD.10475.C1_at | AGGCTATACTCAACACACGTGCAATTGAAAGCAGGCGAGGCAAAACCAGGGCAGAGGAAAGGA AAGGGGTGTGTGTAGGTATGGATTTATGGGTAGGTAGGTCGGTAGGTTAGTTGAAGAGGAG GTTCTAAGCAGTATAACCTAAGCCTCTTTTCTCTTTCTTCTGCTTCAAACACCTTAAGAACTG CTCAGGGTAGACTGGAGACAAAAGCAACAGCTCAGAAGTGCTAAATCTTGAAGAGCAGCCAAA GCATGGGCAACA | SEQ ID NO: 1419 |
| GSR | ADXCRAG_AY338490_at | TCACTTGAGCTTGGGTGAGGTGAGGCTGCAGTGAGTCCTGATCATGCTGCTGCACTCAATCTT GGACAACA | SEQ ID NO: 907 |
| GSR | ADXCRIH.3783.C1_s_at | GACATCACTGATGATACGGCATGATAAGGTACTTAGAAGTTTTGATTCAATGATCAGCACCAA CTGCACGGAGGAGCTGGAGAACGCTGGCGTGGAGGTGCTGAAGTTCTCCCAGGTCAAGGAGGT TAAAAAGACTTTGTCGGGCTTGGAAGTCAGCATGGTTACTGCAGTTCCCGGTAGGCTACCAGT CATGACCATGATTCCAGATGTTG | SEQ ID NO: 1148 |
| GSR | ADXCRPD.5551.C1_at | AGACCGGCAATTTATGAGGAGTAGTAGGCGCACGGTACGCATCGCTCGTACCCATGTGACGCA AGGTCGACGCGGCCTNACTTACTAGGTGACTGACAGCGGGATGGGTGTGTCGTCACCCGGTCC GCGCCCCACCACGCCCATGGTGATATGACGTTTCACTATAGTCCTAGACAGACGTACTCGTAT TTGCCCACGGGTCTCTGATGCTANACACCCACGCTGTTGCTCCANCGTTATTACCCATACCAC AAGAATGACGAGNCNCCCCTCTATTTTATTACACAGCGACGCCACG | SEQ ID NO: 1722 |
| GSR | ADXCRAD_BM978758_at | AGCCTCACCTCACCCAAGCTCAAGTGATCCTCTCACCTCAGCCTCCCAAGTAGCTGAGATTAC AGATGCACATCACCACACTCGGGTAATTTTTTTACTCTCTGTAGAGATGCAGTCTTGCTATG CTGTGCATGCTGGCCTCAAACTTGTAGGCTCAAGTAA | SEQ ID NO: 2750 |
| GTF2E1 | ADXCRAG_BC005917_at | AGACTGCTGCAGACGGGAAAACCACTCGCCATAACTACTACTTCATCAATTATCGTACTCTTG TTAATGTGGTAAAATATAAACTGGACCACATGAGCAGAAGAATTGAGACCGATGAGAGAGATT CGACCAACCGGGCTTCCTTCAAATGTCCTGTCTGTAGTAGTACTTTCACAGACTTAGAAGCTA ATCAGCTCTTTGATCCTATGACAGGTGAGGTTTATCCAGTTTGT | SEQ ID NO: 920 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| GTF2E1 | ADXCRAD_BG571275_at | TGAGCCTTGTATGGAGTGATGTTTCATTTACCTGGGTTGTGTTAATGACTGAATGTTGACCAT AAATCTGTTTTATACTGACTGAAGTTTGTCATTTTTAAGTTCCTTGTAACCATCTTGCGCGCA TATTCACCATTGAACTATTCTTTCCCAATATAAAAATACACGAACACACACACTTTTTCTGGC CCTCTGGCCCCTCTAAAAAATTTTTTTGACACCAATCGTTGGGCGGCGGCCCCGTGTGTTTGG AACAAGTGTGAACAAGGTTCCAAA | SEQ ID NO: 2449 |
| HMGB1 | ADXCRAG_AL110194_s_at | AAATCTATAATTAATTGGGCCAACTTTTAAAATGAAGATGCTTTTTAAAACTAATGAACTAAG ATGTATAAATCTTAGTTTTTTTGTATTTTAAAGATAGGCATATGGCATATTGATTAACGAGTC AAATTTCCTAACTTTGCTGTGCAAAGGTTGAGAGCTATTGCTGATTAGTTACCACAGTTCTGA TGATCGTCCCATCACAGTGTTGTTAATGTTTGCTG | SEQ ID NO: 888 |
| HMGB1 | ADXCRAG_U51677_x_at | ATGATGAATAAGTTGGTTCTAGCGCAGTTTTTTTTTCTTGTCTATAAAGCATTTAACCCCCC TGTACACAACTCACTCCTTTTAAAGAAAAAAATTGAAATGTAAGGCTGTGTAAGATTTGTTTT TAAACTGTACAGTGTCTTTTTTGTATAGTTAACACACTACCGAATGTGTCTTTAGATAGCCC TGTCCTGGTGGTATTTTCAATAGCCACTAACCTTGCCTG | SEQ ID NO: 1068 |
| HMGB1 | ADXCRIH.157.C4_s_at | TTTAGTAGGTACGTCATGACAACTACCATTTTTTTAAGATGTTGAGAATGGGAACAGTTTTTT TAGGGTTTATTCTTGACCACAGATCTTAAGAAAAT | SEQ ID NO: 1289 |
| HMGB1 | ADXCRAD_CN401906_s_at | AACTCATTCATTAGTCATGTTTATCTGCTTAGGAGTTTAGGGAACAATTTGGCAATTTTGTGG TTTTCGAGATTATCGTTTTCTTAAAGTGCCAGTATTTTAAAATAGCGTTCTTGTAATTTTACA CGCTTTTGTGATGGAGTGCTGTTTTGTTATATAATTTAGACTTGGATTCTTTCCATTTGCATT TGTTTATGTAATTTCAGGAGGAATACTGAACATCTGAGTCCTGGATGATACTAATAAA | SEQ ID NO: 2402 |
| HMGB1 | ADXCRAD_BX429991_at | GTATGGTCTAACCTTTACCATAGGACTTTATTCTTTAAACTCCATTACATGTAAGGGCCGTTA TATTTTGCAGCCTCCACATTAAGAATACTTGGTATGCTTTCTCCAAAGCGGTGAGCTTATATA CAAGACTGGCATATTAAAATTTTCCGCTACACTTACTCCAAGAAAGCTTTGGAATAGCAGTCT TAT | SEQ ID NO: 2572 |
| HMGB1 | ADXCRAD_DN601918_x_at | GATGCTTCAGTCAACTTCTCAGAGTTTTCTAAGAAGTGCTCAGAGAGGTGGAAGACCATGTCT GCTAAAGAGAAAGGAAAATTTGAAGATATGGCAAAAGCGGACAAGGCCCGTTATGAAAGAGAA ATGAAAACCTATATCCCTCCCAAAGGGGAGACAAAAAAGAAGTTCAAGGATCCCAATGCACCC AAGAGGCCTCCTTCGGCCTTCTTCCTCTTCTGCTCTGAGTATCGCCCAAAAAATCAAAGGAGAA CATCCTGGCCTGTCCATTGGTGATGTTGC | SEQ ID NO: 2603 |
| HMGB1 | ADXCRAD_CX757597_at | GAAAAGCGCCCATGTAACACAAACTGCCATTCAACAGGTATTTCCCTTACTACCTAAGGAATT GTACCATTGCTCAGAATTGTAGGATTTACTATGTTGAAACTACAGGAGAGCCGGGCGCATGGT CACCCTGTATCCAGCCTTTGGAGGCANGCGGCAATCACAGTCAGAATGAACATCTGCTACTGT GAACCGCTCATAAATCAAAATACACTGTGCTGCCTGATCATATCGAGTAGCGAATGTGACGAG GATCAGACATGCTGCCACGGA | SEQ ID NO: 2620 |
| HRSP12 | ADXCRIH.2614.C1_s_at | TACACCTGTGTGCACCTGTATTACTGAATATAGGAAAGAGATACCCATTACATAGTTACTCAG TAAACAAAAAGAGAAATACCAGGTAGGAAAGAAGAGTTACTATTCCTGAGAAATAATCAAGAA CATATTTAATTTAAACTAATGATGTGAACTATTTAGTTTTGATGTCCGTTATGTGATTCTGCT TTTACTTGAGTAAAAT | SEQ ID NO: 1098 |
| HSP90AB1 | 200064_at | AATAGACTTGTGTCTTCACCTTGCTGCATTGTGACCAGCACCTACGGCTGGACAGCCAATATG GAGCGGATCATGAAAGCCCAGGCACTTCGGGACAACTCCACCATGGGCTATATGATGGCCAAA AAGCACCTGGAGATCAACCCTGACCACCCCATTGTGGACGCTGCGGCAGAAGGCTGAGGCC GACAAGAATGATAAGGCAGTTAAGGACCTGGTGGTGCTGCTGTTTGAAACCGCCCTGCTATCT TCTGGCTTTTCCCTTGAGGATCCCCAGACCCACTCCAACCGCATCTATCGCATGATCAAGCTA GGTCTAGGTATTGATGAAGATGAAGTGGCAGCAGAGGAACCCAATGCTGCAGTTCCTGATGAG ATCCCCCCTCTCGAGGGCGATGAGGATGCGTCTCGCATGGAAGAAGTCGATTAGGTTAGGAGT TCATAGTTGGAAAACTTGTGCCCTTGTATAGTGTCCC | SEQ ID NO: 833 |
| HSP90AB1 | ADXCRIH.3279.C1_x_at | CTTGTATAGTGTCCCCATGGGCTCCCACTGCAGCCTCGAGTGCCCCTGTCCCACCTGGCTCCC CCTGCTGGTGTCTAGTGTTTTTTTCCCTCTCCTGTCCTTGTGTTGAAGGCAGTAAACTAAGGG TGTCAAGCCCCATTCCCTCTCTACTCTTGACAGCAGGATTGGATGTTGTGTATTGTGGTTTAT TTTATTTTCTTCATTTTGTTCTGAAATTAAAGTATGCAAAAATAAAGAATATGCCGTTT | SEQ ID NO: 1100 |
| HSP90AB1 | ADXCRAD_DN602116_s_at | GAAAGTGGTTGTGATCACAAAGCACAACGATGATGAACAGTATGCTTGGGAGTCTTCTGCTGG AGGTTCCTTCACTGTGCGTGCTGACCATGGTGAGCCCATTGGCAGGGGTACCAAAGTGATCCT CCATCTTAAAGAAGATCAGACAGAGTACCTAGAAGAGAGGCGGGTCAAAGAAGTAGT | SEQ ID NO: 2329 |
| HSPD1 | ADXCRAG_AJ250915_at | TTTGTACATTCCTGATACTGGGTACAAGAGCCATGTACCAGTGTACTGCTTTCAACTTAAATC ACTGAGGCATTTTTACTACTATTCTGTTAAAATCAGGATTTTAGTGCTTGCCACCACCAGATG AGAAGTTAAGCAGCCTTTCTGTGGAGAGTGAGAATAATTGTGTACAAAGTAGAGAAGATATCCA ATTATGTGACAACCTTTGTGTAA | SEQ ID NO: 881 |
| HSPD1 | ADXCRAD_BM313583_s_at | AACAGCATGATTGGGTTAGGAATTTGCATAGGATGAGTTCAGTGGTGAGACTTTTGAAACTAC ACACATCTACCTTGTTTTAGTCCTATTTTCAAAATTTTGGCATTGTGAGATTTATTTACTGT GTGAACCTAAAGTTACTGTTTAAGTACATGCCACGCAACTCTGTTATTAAGAAGCACTGTC TCAGAAGCTGTGTGTAAATTTAATATTAAGGCACTAAAGACCAAGCATAGGTACATGCCTGTA | SEQ ID NO: 2588 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| HSPD1 | ADXCRAD_AW674195_at | TTTTTATTACACAAAGGTTGTCACATAATTGGATACTTCTCTACTTTGTACACAATTATTCTC ACTCTCCACAGAAAGGCTGCTTAACTTCTCATCTGGTGGTGGCAAGCACTAAAATCCTGATTT TAACAGAATAGTAGT | SEQ ID NO: 2850 |
| HSPD1 | ADXCRAD_AW674195_x_at | AATGTTTTACACACATGCCAGCCTGCCCTTCAACTGGCTTTCAATTTTCAGTATCTTCTAATC ATGGAAATGCTAACACAATTATTAACTTTAAACAAATTTTTATTACACAAAGGTTGTCACATA ATTGGATACTTCTCTACTTTGTACACAATTATTCTCACTCTCCACAGAAAGGCTGCTTAACTT CTCATCTGGTGGTGGCAAGCACTAAAATCCTGATTTTAACAGAATAGTAGT | SEQ ID NO: 2851 |
| HSPE1 | ADXCRIHRC.2093.C1_s_at | GGACTGCAGCTAAGTGTCCACTCCCCAAAGTCTTCCTATTCCTAACTCCATGACAGCTCCTCA GTAGAGCTTTCCTCCTCAGAAGCAACTAGAACAATGCAGTTAACATTATTTGGCCCCAACGGC GTTTACTGTGTATTTTGGCTGAGATCTTTAGAAGCCCGAGGCCTAAACAATTAACTGAGGAAC ATCTAA | SEQ ID NO: 1380 |
| HSPE1 | ADXCRIH.2093.C1_at | TTCTAGATGACAAGGTGTGTAAACTTAATAATTCTAAAAGAAGTCAGATATTTGCAATTAGT TGTCTTAACTAATGGTTTTTTTCACTTGCAGGATTATTTCCTATTTAGAGATGGTGACATTCT TGGAAAGTACGTAGACTGAAATAAGTCACTATTGAAATGGCATCAACATGATGCTGCCCATTC CACTGAAGTTCTGAAATCTTTCGTCATGTAAATAATTTCCATATTTCTCTTTTATAATAAACT AATGATAAGTAATCCTCGTGC | SEQ ID NO: 2247 |
| HSPE1 | ADXCRIH.2093.C1_s_at | GAATATGGAGGCACCAAAGTAGTTCTAGATGACAAGGTGTGTAAACTTAATAATTCTAAAAAG AAGTCAGATATTTGCAATTAGTTGTCTTAACTAATGGTTTTTTTCACTTGCAGGATTATTTCC TATTTAGAGATGGTGACATTCTTGGAAAGTACGTAGACTGAAATAAGTCACTATTGAAATGGC ATCAACATGATGCTGCCCATTCCACTGAAGTTCTGAAATCTTTCGTCATGTAAATAATTTCC | SEQ ID NO: 2248 |
| HSPE1 | ADXCRIH.2093.C2_at | TTCTAGATGACAAGGATTATTTCCTATTTAGAGATGGTGACATTCTTGGAAAGTACGTAGACT GAAATAAGTCACTATTGAAATGGCATCAACATGATGCTGCCCATTCCACTGAAGTTCTGAAAT CTTTCGTCATGTAAATAATTTCCATATTTCTCTTTTATAATAAACTAATGATAACTAATGACA TCCAGTGTCTCCAAAATTGTTTCCTTGTACTGATATAAACATTCCAAATAAA | SEQ ID NO: 2249 |
| HSPE1 | ADXCRI H.2093.C2_x_at | TTCTAGATGACAAGGATTATTTCCTATTTAGAGATGGTGACATTCTTGGAAAGTACGTAGACT GAAATAAGTCACTATTGAAATGGCATCAACATGATGCTGCCCATTCCACTGAAGTTCTGAAAT CTTTCGTCATGTAAATAATTTCCATATTTCTCTTTTATAATAAACTAATGATAACTAATGACA TCCAGTGTCTCCAAAATTGTTTCCTTGTACTGATATAAACATTCCAAATA | SEQ ID NO: 2250 |
| IL27RA | ADXCRAD_BG756941_at | GCAAGACCCTCAGTACAAAATAAACGTCAGAAACAAAAACAATTAGCTTGGGGCATTATGCA CACACCTGTTATCCGAGCCACTTGGAAGCTGAGGGGAGATCGGTTGAGCCAGGAGTTCGAAG TGAGGACTCTGATTGCACATGGATCCAGGTGCGTACCAATGGACTTTTTCAAATA | SEQ ID NO: 2631 |
| IL27RA | ADXCRAD_NM_004843_at | AACACTGCATTTGGGCACCATCTCAGCTCCCTTGCATCCAGGTGCAGCATGGACTGAGTTCTT GACAACAGAATGTGGTCAGAAGTGACATATGCCAACACGGGGTCTGGGTGGGGCTCCCCCAC ATCCTTTCCTTGCCTATGAGCTGGAACATAACACATGCCTATGATCCAGCTTTGGTCATACCC AAGGGGAAGGTGGAGCAAGAAATGAAAAGGAACCTGAATCCCTGAATGACTGCATGGATAGAA CCACT | SEQ ID NO: 2770 |
| INSIG1 | ADXCRIH.1510.C1_s_at | GAATGACCCCCTTATATATTTTCTGAAAATGAAAACAGTTACATGAAAAAAATTTCCAATGAA GATGTCAGCATTTTATGAAAAACCAGAAGTTATTAGATGAAAGCAGCGAGTGAATCTTTAAAC AGACTTGATCACGCACACACAATAAGTCTTTCTCTCC | SEQ ID NO: 1196 |
| INSIG1 | ADXCRAD_BU191559_at | AATCTATTTAGATCGGGCTGACTGTACAAATGACTCCTGGAAAAAACTCTTCACCTAGTCTAG AATAGGGAGGTGGAGAATGATGACTTACCCTGAAGTCTTCCCTTGACTGCCCGCACTGGCGCC TGTCTGTGCCCTGGAGCATTCTGCCCAGGCTACGTGGGTTCAGGCAGGTGGCAGCTTCCCAAG TATTCGATTTCATTCATGTGATTA | SEQ ID NO: 2371 |
| INSIG1 | ADXCRAD_BU570382_at | GATTTTTTTGCCAATAGTTTATAGAAAATATATGAACCAAAGTGATTTGAGTTTGTAAAAATG TAAAATAGTATGAACAAAATTTGCACTCTACCAGATTTGAACATCTAGTGAGGTTCACATTCA TACTAAGTTTTCAACATTGTGT | SEQ ID NO: 2372 |
| INSIG1 | ADXCRAD_BU570382_x_at | GATTTTTTTGCCAATAGTTTATAGAAAATATATGAACCAAAGTGATTTGAGTTTGTAAAAATG TAAAATAGTATGAACAAAATTTGCACTCTACCAGATTTGAACATCTAGTGAGGTTCACATTCA TACTAAGTTTTCAACATTGTGTTCTTTTTGCATTCATTTTTTA | SEQ ID NO: 2373 |
| INSIG1 | ADXCRAD_AL541939_s_at | TTTTAAATTCTGTGAAAGTGGCTTGATTAAAAG | SEQ ID NO: 2611 |
| KBTBD11 | ADXCRPD.18308.C1_at | AGGCAGTCTCAGCAATGCCTCTGCCCTCCCTGCAGCAGTCCCAAAATGAACAGCCACACCTTG GAGGGTGTGGCTTTTCTGTTTCATGCGGTGCAAACCCTAGCGGCTCCACACCCCAGGGACTGG CCCCCAAAAAGCAAAAACACTGCTCATGGCTTGGCAGGTCCTCAGTATGTATTTTTATGTGA TATCACTATTCAGAACTGTGGTGTATACTATTCTATAAATTTCCACTATAGGTTGGCCGGACA TCCTTTAATGCTGGGTATTAATTCCTCTTATTCT | SEQ ID NO: 1420 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| KBTBD11 | ADXCRPDRC.18308.C1_at | GGTTCATGTGAGATGCAGAGGCAATGAGCTTGAGCCTTCCTACCTTTACTTCCGGCTGGATAC<br>TTGCTCTGGGGAACAATCCCATCAATACCGCAGACGGCTTTGCCGGCCGCCTTCGCCAAAGCC<br>TGGGATTCGGAAACATACGGGGAAACGGGGCGCGGAATCCGAGGAGGGCCACGACAGCGACCA<br>GGGAGAAAACGGCAGGTGCGGGAAGAACCTGGGCCACACAACAAAAACACGGAAGTGAGAAC<br>ACCTGGCCACACGAAGGAAGACATGAA | SEQ ID NO: 1927 |
| KBTBD11 | ADXCRAD_NM_014867_at | CTTCAGACACGCCAAGTGGATGGATTTGGATTGAACGCATATGAAACAGGAGACGGGTTCTCA<br>TGTGAGATCAAAGCTCCTCCAAAGCCTGTTCAAGCTCTAAGCGATTCTCAAATGTTACCATTT<br>ATTAAAGGTAAACTACACCTGTTGAAGGCCAAGTTCAGGGCAGCTGTTGTGATCTGTGTAGTT<br>AATGTATTTATTAATGCTTGACTTTTAAAATCCTGGGCATAAATAGTGCAGAGCCTCGTATGT<br>TTGTCAGTTCATGCCGAGATG | SEQ ID NO: 2772 |
| LGALS4 | ADXCRIH.255.C1_at | AGAAGAAGATCACCCACAACCCATTTGGTCCCGGACAGTTCTTTGATCTGTCCATTCGCTGTG<br>GCTTGGATCGCTTCAAGGTTTACGCCAATGGCCAGCACCTCTTTGACTTTGCCCATCGCCTCT<br>CGGCCTTCCAGAGGGTGGACACATTGGAAATCCAGGGTGATGTCACCTTGTCCTATGTCCAGA<br>TCTAATCTATTCCTGGGGCCATAACTCATGGGAAAACAGAATTATCCCCTAGGACTCCTTT | SEQ ID NO: 1258 |
| MRPL16 | ADXCRIH.2001.C1_s_at | ACATGCTGGGCATACGGAAAGTACTGAGCCCATATGACTTGACCCACAAGGGGAAATACTGGG<br>GCAAGTTCTACATGCCCAAACGTGTGTAGTGAGTGTAGGAGATAACTGTATATAGGCTACTGA<br>AGAAGGATTCTGCATTTCTATTCCCCTCAGCCTACCCACTGAAGTCTTTGGGTAGCTCTTAA<br>GCCATAACTAAGGAGCAGCATTTGAGTAGATTTCTGAAA | SEQ ID NO: 1144 |
| MRPS2 | ADXCRAD_AL583494_s_at | TTGGCTGCAGTTAGGACCTCAGTGGCTGGTATGGCCGAGCTGCTAGAAGATGCTGCTGTCCCT<br>GTGATCCCAGCAGCCCTCCCTTCACCGTGACCCCTGACCTTTGTCAGGAAGGTGCAGTTTTTC<br>TTCTCAATCTAAATGCCTTTCAGGTGGGCCGCTTCCTTGGCTACCTGGTTCCAGGGGGCTGTT<br>TTGTAATGAGATGCTGCTGGCAGGCCACTCAGAGGCTCCCAGCTGGGTTGGTGGGACAGCCAG<br>GCCAGATGACCTGATTCCAGCAAAAATAA | SEQ ID NO: 839 |
| MRPS35 | ADXCRIH.1462.C1_at | AAACTTGTAGGAGAGCGATACTGCAAGACCACAGATGTGCTTACCATCAAAACAGATAGGTGC<br>CCTTTAAGGAGGCAGAATTACGATTATGCAGTGTATCTACTAACAGTGTTATACCATGAGTCT<br>TGGAATACTGAAGAATGGGAAAAAGTAAGACTGAAGCAGACATGGAAGAGTATATATGGGAA<br>AATAGCTCATCAGAAAGAAATATCCTGGAAACGCTCTCCAGATGAAAGCTG | SEQ ID NO: 1155 |
| MRPS35 | ADXCRIH.2579.C1_at | AATGGGTTCTGGGCCTGCCTTCCCAGGTAACCAAAACCATTATTCAAAAGCAACTACTGAAAT<br>GCCAGCTTGTGGGGAAAGAAATGGGAAAGGTGATAAAATCACAATTAAATGCATGTATATACA<br>TGAATACCAAAGCTATTATGTAGAAATAAAATCAAAACACTTTAGACCAAGAAGAAATCAGAG<br>ACCTCCTAGTCTATTGCCCCCAGTGTAAAAATTAAAAAACTCTGGAGTAATCATTGCCATTAA<br>GCATTAGTATG | SEQ ID NO: 1213 |
| MRPS35 | ADXCRIH.2579.C1_x_at | AAGGAAATGGGTTCTGGGCCTGCCTTCCCAGGTAACCAAAACCATTATTCAAAAGCAACTACT<br>GAAATGCCAGCTTGTGGGGAAAGAAATGGGAAAGGTGATAAAATCACAATTAAATGCATGTAT<br>ATACATGAATACCAAAGCTATTATGTAGAAATAAAATCAAAACACTTTAGACCAAGAAGAAAT<br>CAGAGACCTCCTAGTCTATTGCCCCCAGTGTAAAAATTAAAAAACTCTGGAGTAATCATTGCC<br>ATTAAGGATTAGTATG | SEQ ID NO: 1214 |
| MRPS35 | ADXCRIHRC.2579.C1_at | GGCTCATTTTGCCAGGGCCAAGCTACCAGAAAAGTAGAAGTGGAGATTACCTGGTATGTATCT<br>CTCTGGGTGCCCCAGTTAGAGCTGCCACAGCTCAGGAAAAAGATGAGGCATAACGACCTTGAA<br>TGTAATTGGAGTAAGTGACAAAATAAGAACTACCCTGGGAAACCCTGCATTCAATGTAGCTGT<br>CAATTCAGTATTTTTAAGTACACCTGTCAGCTGTTTCTTACCACTTCGATGGTTGTGATTA | SEQ ID NO: 1324 |
| MTHFD2 | ADXCRI H.873.C1_s_at | GCTGCAAAAAGGTGCTGAGGCTTGAAGAGCGAGAAGTGCTGAAGTCTAAAGAGCTTGGGGGT<br>AGCCACTAATTAACTACTGTGTCTTCTGTGTCACAAACAGCACTCCAGGCCAGCTCAAGAAGC<br>AAAGCAGGCCAATAGAAATGCAATATTTTTAATTTATTCTACTGAAATGGTTTAAATGATGCC<br>TTGTATTTATTGAAAGCTTAAATGGGTGGGTGTTTCTGCACATACCTTCTGCAGTACCTCACC<br>AGGGAGCAT | SEQ ID NO: 1189 |
| MUC13 | ADXCRIH.333.C1_s_at | GGGTGTAGGTTTCTGAGGTGTGCCATTGGGGCCTCAGCCTTCTCTGGTGACAGAGGCTCAGCT<br>GTGGCCACCACANNNNNNNNNNNNNNNNNNNNNNNNNNNNNNNNNNNNNNNAATGGGGGCAACCACATCCA<br>GTACAAGCTTTTACAAATGTTATTAGTGTCCTTTTTTATTTCTAATGCCTTGTCCTCTTAAAA<br>GTTATTTTATTTGTTATTATTATTTGTTCTTGACTGTTAATTGTGAATGGTAATGCAATAAAG<br>TGCC | SEQ ID NO: 1126 |
| MUC13 | ADXCRIH.2577.C1_s_at | AAGATCTGAAATGCGTGCTGATGACAAGTTTGTTAATGTAACAATAGTAACAATTTTGGCAGA<br>AACCACAAGTGACAATGAGAAGACTGTGACTGAGAAAATTAATAAAGCAATTAGAAGTAGCTC<br>AAGCACTTTCTAAACTATGATTTGACCCTTCGGTGTGATTATTATGGCTGTAACCAGACTGC<br>GGATGACTGCCTCAATGGTTTAGCATGCGATTGCAAATCTGACCTGCAAAGGCCTAACCCACA<br>GAGCCCTTTCTGCGTTGCTTCC | SEQ ID NO: 1212 |
| MYC | ADXCRIH.2640.C1_s_at | TGATCAAATGCAACCTCACAACCCTTGGCTGAGTCTTGAGACTGAAAGATTTAGCCATAATGTA<br>AACTGCCTCAAATTGGACTTTGG | SEQ ID NO: 1105 |
| MYC | ADXCRPD.8111.C1_at | CAGTGTCCGTCTCCGGCTGTCAGAAATGCGGTGAGCCGAAATTTAAATGCCCTCCCGGAGACG<br>GGGACAAGTCAGCGGCTGCGGAGCGATCTGGCTCACACAGGCGATATGCGGTCCCTACTCCAA | SEQ ID |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| | | GGAGCTCAGGATGCAAGGGGCTTTCTGCCCACCGCAAAGCAACCCCCAGCCCCCAAAACCCA GAGAGCAATTAACACAATAAAGCAGGAATGTCCGACCGGCCGGGAGTCAGCGTGAATATATTC ATAAGGCAGAAATCTCGAAAGGGTAGTCTT | 1806 |
| MYC | ADXCRSS.Hs#S854806_at | GGGAGGAGACTCAGCCGGGCAGCCGAGCACTCTAGCTCTAGGATGTAAACAGAGTAAGAGAGC CGCATGAATTAACTACGCGCGCCTACCATTTTCTTTTGCTCCCTCTCAAACCCTCTCCCTTTC TCTGCTGCTCCTCCGTAGCAGTACTGTTTGACAAACCGCATCCTTGTCCTGTGAGTATAAATC ATCGCAGGCGGAACAGCTG | SEQ ID NO: 2226 |
| MYC | ADXCRAD_CA454569_at | TAAATATTGGGCCATTAAATGGTAAATAAACTTTTAATAAAACCGTTTTATTAGCAAGTTACA CCAGAAATTTCAATCCCCTAGGTATATATAGTACCCTCAAGTATTTATTA | SEQ ID NO: 2390 |
| NDUFAB1 | ADXCRIH.1103.C1_s_at | TTGGGTTTGAAATTCCTGATATAGATGCTGAAAAGTTAATGTGTCCACAAGAAATTGTAGATT ACATTGCAGATAAGAAGGATGTATATGAATAAAGTATCAGACCCTTTGGCTTTGCTGAGAGAG GACTCAGATGATAGTGACGAATGTCTGGCAGTGAGGACACATTTTGGCATTCTTGCTGACTCT GACAGAGTGATTCTGATGGACTTGTATTTAA | SEQ ID NO: 1172 |
| NUP37 | ADXCRIH.1894.C1_s_at | AAATTCATCATTTAGGACACCCTCAGCCCATCCTCATGGGTTCTGTAGCCGTTGGATCTGGAC TGTCCTGGCATCGAACTCTCCCTCTGTGTGTAATTGGAGGAGACCACAAGCTGTTGTTTTGG GTGACTGAAGTATAAAGTGTTTTCTGTACCTTAGATTCACAAACTTTGTATTTTTAGTACATA TTTTGAAGAATTTCTATAGTACATATTTTGAAGAATTTTTATATCAAATATACCGTATACTTT AGAAAATGTCTCAGTTGCTTTTATTA | SEQ ID NO: 1171 |
| NUP37 | ADXCRSS.Hs#S1923985_at | AAGCAACAAGTAAACACACCTATGAAAGCAACTTGTTTGAGCTGTCTCAACTTCTCTGCAGCT GTTCTGGCTGTATCTGTATTCTAGTACTTCTTTGAACTCTAGAGAAAAGTTTGTTCATCAAAA CCTCATGAAGTTTAAAGGTAGTCTATTGCCTTTTGTCCTTTTTCAAAAATCTTATTTCTTTAT TTAAATTGACAGGTAAAAATTGTATTTTTATGATGTACAACATGATGTTTTGATATATGAATA CATTGTGGAATGGCCAAACCAAGCAACC | SEQ ID NO: 2111 |
| PDCD4 | ADXCRAG_NM_014456_s_at | CATTACTGGTGGGATCTGGTCACACAAGATAGCATTAAACGTGACATGGCACATAAAATTGGT TAAAAAATTTTGTTTTTTAATTACGTAATGTAAAAGCCCAACAAACACTTTATGCAAGATTGG<br><br>AATGTATCTTCAA | SEQ ID NO: 1042 |
| PDCD4 | ADXCRPD.13022.C1_s_at | GAAATTCCGGACATTAATCTGGATGTCCCACATTCATACTCTGTGCTGGAGCGGTTTGTAGAA<br><br>GAATGTTTTCAGGCTGGATAATTTCCTTACAACTCAGAGATCTTTGTCCTTCAAG | SEQ ID NO: 1567 |
| PDCD4 | ADXCRPD.5572.C1_s_at | TTCCAGGGAACATACTGATTGGTCTTAAAAGACTAGACAGTTAAGTAAAAGGTGGCTGGAACA TCTATTTTCTACAAAACTGGAAAAATGAACCTGGTTCTAGAAGAATGTACACCAAAATAAAA CATGTGAAGCAGTATTGATTCTTTATTGGGAGTACATTTTTTAGGTCTCTTAAACTTTAATTT CACACA | SEQ ID NO: 1724 |
| PDCD4 | ADXCRSS.Hs#S1435288_at | TGTTCCCACGGAGGTTTCTGCTTGTTCCCAGTAAGTTGTGATTCTCTGTATCCACGTGTCTTT CTCCAATTTGGGGGGCTTCAGTTTGCTCTGTGACCTCCATTCTCTGATGGATCTAAGAAGAGT TGTTGATTTTCAGTTTGTTTAGCTATTTGTTAGGACAGAGTGACAACTTTCAAGCTCCTTACA TGCTGCATCAGAAACCAGAA | SEQ ID NO: 2076 |
| PDCD4 | ADXCRAD_BE544684_at | ATTTACTATGTATGTTTCACTTACAATTTGTAGGGAAAAAAAGTCTTCAAGGGAACACTAAGA TTAAATGACCTAGCGTTCAAATATGCTTCCTTATGAGATTCACAATTTACCTGTGTGAAATTA ACGTTCTAAGAGACCTAAAAATGTTCTCCCCAATAAGAACTCATACT | SEQ ID NO: 1567 |
| PDCD4 | ADXCRAD_BE544684_x_at | AAGTGATACCTGCATTTTTTCCCCAGGTAATCTTAATTTACTATGTATGTTTCACTTACAATT TGTAGGGAAAAAAAGTCTTCAAGGGAACACTAAGATTAAATGACCTAGCGTTCAAATATGCTT CCTTATGAGATTCACAATTTACCTGTGTGAAATTAACGTTCTAAGAGACCTAAAAATGTTCTC CCCAATAAGAACTCATACT | SEQ ID NO: 2548 |
| PDCD4 | ADXCRAD_BM550622_at | TCTGACCTAGAGCTTTATTTAAGTTTTAGAAATATGTAATACCTTTCATCATTCCATCATCC CTAAATTCTGNTACCCAAATAATGGCTAATGTTACAAAAAGTTATACTCCCAGAGACCCAA AGCTTGACATTTACCTATTGTATTGAGAAATTATTCCCAATACCAATAAAGGAATGGTCCTA TTTTTTAACCCCTCTTTTAACTAGCCTAATACCTCCCGCAAGGCCCTCAACGTCCT GGGGCTA | SEQ ID NO: 2663 |
| PDCD4 | ADXCRAD_BM550622_x_at | AATGCAGGTATCACTTTTACTCCATTGTTATCTGACCTAGAGCTTTATTTAAGTTTTAGAAAT ATGTAATACCTTTCATCATTCCATCATCCCTAAATTCTGNTACCCAAATAATGGCTAATGTTA CAAAAAGTTATACTCCCAGAGACCCAAAGCTTGACATTTACCTATTGTATTGAGAAATTATTC CCAATACCAATAAAGGAATGGTCCTATTTTTTAACCCCTCTTTTAACTAGCCTAATACCTCCC GCAAGG | SEQ ID NO: 2664 |
| PDCD4 | ADXCRAD_BC043171_at | CATTGGTAGGGAACTATCCAGTATTTATATTCCTATGTATGTATATCAGATTAATTTTGAGGC TTGGTATTCCTAAAAGATTTGGATGTGTGTATTTCTTTAACTTGACGTAAACATGTATCACAA ACATATCTTTTAATTCCAATTAAAGGGGTGCTTTGGCACATGCTG | SEQ ID NO: 2781 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| PDCD4 | ADXCRAD_BC043171_x_at | CATTGGTAGGGAACTATCCAGTATTTATATTCCTATGTATGTATATCAGATTAATTTTGAGGC TTGGTATTCCTAAAAGATTTGGATGTGTGTATTTCTTTAACTTGACGTAAACATGTATCACAA ACATATCTTTTAATTCCAATTAAAGGGGTGCTTTGGCACATGCTGAAATCTGGGATTTT | SEQ ID NO: 2782 |
| PDSS1 | ADXCRAD_BM824056_s_at | AACTTCGACCATCCCCAGAAAGAGATGCCCTCATTCAGCTTTCAGAAATTGTACTCACAAGAG ATAAATGACAACTCTTTCTGTTCTTTCTGGCAGCTATCTTACCAGACTGTGCCTAAAGAATTT TGTGGAATACACTTTGTTTGCTTCATGTGCAGATAACCAAAAATCATTTTAAAAGATATCAAA CTTATTGATGGGCAAT | SEQ ID NO: 862 |
| PDSS1 | ADXCRPDRC.11127.C1_at | GCACACCATCACTCTGTAGTACATACTGTCGAGCTCTGTCTACATCTCCAGGCAAACTGAACC GTCGCATGATCATAGCATTCATTTCTGGAACTGCTGACAGGCAAACAGGACAGGACCAGTGG CTAACCCGAGCTTCAGATCAGCTGATGTTGGTTTGCCCATCTGGTCAGAACACGAGGTGAAGT CCAATACATCATCTATTAGCTGAAAAGCTATTCCTACATTTTTTCCGTACTGATAGGCGATCC CA | SEQ ID NO: 2058 |
| PGD | ADXCRAD_CX873763_s_at | ACAGACCAGGACATTCCATGTGCCTCATGGCACTGCCACCTGGCCCCTTGCCCTATTTCTGT TCAGTTTTTTAAAAGTGTTGTAAGAGACTCCTGAGGAAGACACACAGTTTATTTGTAAAGTAG CTCTGTGAGAGCCACCATGCCCTCTGCCCTTGCCTCTTGGGACTGACCAGGAGCTGCTCATGT GCGTGAGAGTGGGAACCATCTCCTTGCGGCAGTGGCTTCCGCGTGCCCCGTGTGCTGGTGCGG TTCCC | SEQ ID NO: 912 |
| PMM2 | ADXCRPD.16616.C1_at | CTGGCCAAGTGGGAGCAGACCCTAGGGAGTTTGCACCTCGGCTGGGCCGGATTCGGACCGGCT CTGTGTTCACTACACTCAGAATAGCCTGGCTGCTTCTCTGTCTCCGAGACCGGAGGTAGTGGG AACCAACAGCTGGGCTGGAGAGTTGGTGCTGGCAAAACAGTCCTTGCCCTGGGGCCGGTTCTT ACCCAGGTCCAGAGAAACCAACGCGGGATGTCAGACTTCACCAAAAGGACTTTCTGGTTGCCC CTG | SEQ ID NO: 1826 |
| PMM2 | ADXCRAD_BE390153_at | TGGGCACTTGCCGACCTGAGTCTGGGGCCAGGGAGCCCAGGCTGCCCTGCACTCCTGCCTCCC AGCCCCACAGCCAGGTGCTTTCATCACAGCTAAACCTGGTTCCCTCCAAACCTCCCAGCCACTC GGGCTTGTAACTGTCTGAGCCCCGGATCCGTGGGGTGAAAGCAGCCAGCTCATCCCAGTGAC TCACAGGACACAGCCATCCAGCGGCATCTTTCCTTGTCGAATGATACTGTAATGACCTTCCAA AGTGAAGAGTAGCAC | SEQ ID NO: 2408 |
| PPRC1 | ADXCRPD.9220.C1_at | CAGGTATTGAAACAAGTTAACTTGCATTCCTATGTAAGATAGGAGGGGCTGAGGGGATCCCCA GTGTTTGGAACATAAGTCACTATGCAGACTAATAAACATCAACTAGAG | SEQ ID NO: 1398 |
| PPRC1 | ADXCRPD.9220.C1_x_at | TCCCTGCTATCCTTTTTCTCCTTTGGAGGTGCNCCAACCTCCTCCACCCCCTTCCCCTACTCT AGGGGAGAGAGCTGCTAGTGAGATGACTGTTTTATAAAGAAATGGAAAAAAGTGAAATAAAAA ATATGTTGAATCGATTTTTTAAAAGGGGTATTTGTTTTTTTATAACAGGTATTGAAACAAGT TAACTTGCATTCCTATGTAAGATAGGAGGGGCTGAGGGGATCCCCAGTGTTTGGAACATAAGT CACTATGCAGACTAATAAACATCAACTAGAG | SEQ ID NO: 1399 |
| PPRC1 | ADXCRPD.16668.C1_at | AGGGCTTCACTGCAGAGCTGTCTTCTTGGCTGGGGCTGGTGGGATGACAAGACAAGGGATGTC TGCCAGCCCTGTGGGAGTCTCTGGAAGGCTAGGCCACTTCCCAGTTGGGGGCTGTGGACTTCT CTCTTCTGTTTCTGCTTGGCGTTGCTGCCTTCGTCGCCGGTACTCAGATAAGCTGAGAGGCCG AGGTCTGGCTTCATGGGTTGTAGCACTGGTACCACTTTCAATTTTCA | SEQ ID NO: 1832 |
| PPRC1 | ADXCRPDRC.16668.C1_at | GAAGAGAGAAGTCCACAGCCCCCAACTGGGAAGTGGCCTAGCCTTCCAGAGACTCCCACAGGG CTGGCAGACATCCCTTGTCTTGTCATCCCACCAGCCCCAGCCAAGAAGACAGCTCTGCAGTGA AGCCCTGAAACACCCCTTGAGATTTGCCTTGTGCCTATAGGTCCCAGCCCTGCTTCTCCTAGT CCTGAGCCACCTGTAAGCAAACCTGTGCCTCATCTCCCACTGAGCAGGTGCCATCCCAGAAGA TGCCACTGTTGGCGAGACCTT | SEQ ID NO: 2033 |
| PRIM1 | ADXCRPD.724.C1_at | CCGTGAATTGGATGCCATTTCCACTAATGAAGAGGAAAAAGAGGAGAATGAAGCTGAATCTGA TGTCAAACATAGAACCAGAGATTATAAGAAGACCAGTCTAGCACCTTATGTGAAAGTTTTTGA ACATTTTCTTGAAAATCTGGATAAATCCCGAAAAGGAGAACTTCTTAAGAAGAGTGATTTACA AAAAGATTTCTGAAGACAGAGCTCCTCAAACCATTGTGGATATCTTCTGCCTTCAACCACAGA TCAAATACTTCAAGAGCCATTTAATAAA | SEQ ID NO: 2266 |
| PRIM1 | ADXCRPD.724.C2_at | GCCATTGCAACTGGCCGTATTAAGTCCTTTGTATCCTCACTGTTCCATACTAGCTCAGCCTAT GATGTGGACTTCAGCAAATGTGTAAGCAAATCTTTGTGCATGATGTGTGTTAAATAGAAGCAT TAGGCAAAAAGAATGTAAAAGTAAATGGGCTTTGTTTTGTTTCCTTTGCTGTTCTTCCATAT ATTATC | SEQ ID NO: 2267 |
| PRR13 | ADXCRIH.1445.C1_at | TCCACTTATAATACTTGTGATTGGGGAGGTTTGTGGAAATTCAATTATGATGAAAAACCTATC TTTTTTGTAATGTTGGCATACTTGGGGAATTTAGTGGCAAATACATTCCCCAGCAGGCCTTTT GTTGGTTGCACTAACTGCAAGGTTGCTGGGAAGTAGAGTCCATTTGGTTGATGAGCTTTGACT GCGGTTTTGGAACCTTACCTCTCCTCCTTAGCCCAATATGCTGTCTTGGGTCCT | SEQ ID NO: 1285 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| PTGES2 | ADXCRIH.498.C1_s_at | ACAGGACAGCAGGACGGTTTGTTTTCAGTGGA | SEQ ID NO: 1170 |
| RNPS1 | 200060_s_at | CAGGGAAAAGTGAGGCTCTTGGGGGTGGTTTGACCCTGCTTACCTGGGAGCACACTTTTCCCT TCCCCGATGACCTGGGATGGTGGCCAGGCCGTGCCCTTGCTGTTGCTGGGCAGTGTCCTTTTG GAAAGGGAGCTGCCCCAGGCTTTAGTGCAGCTGCCAACCCTGTTAGGCCTGGCCTCTCGAGGC CTCTTCTGATCTCAAGGGTCACACCCCCTCAAAGATCCTCTCACCCATGGTAGTTGCTGCTCG TGGTTCTGTCTGTCCGTGCACCGATGCACACACCGCACCCCACCACTGTACTCTGAAATTGGC GAGTGAGTGGAGAGCCAGCTCTGCGGAGTCATCACGCAGCCATGGTTGTGCCTGCCGTTCATG GTGGTCTTTCAGGTTATCTTGGCAACATGTACATTGCTTTTATTTTTTTCTTTTTTGCTTTC ATTGTACAGTCAGTACTATAAAATTTCTCTTTTGAGTTTTATACCTTTGTAGCATTTTAGATG ACATTGTGTTTGTACTTTGTTG | SEQ ID NO: 832 |
| RNPS1 | ADXCRPD.500.C1_at | ATGCATAGATATACACACCACGCCCCCACCGCGATGTTAACGACACCGCGAGATAATACTATT CCCCCCACACTGCGTCTCTGTTCTGTTTCTNAGCACACCTCTCACCTCTCCTCTTATCTCTGT GGCGGTCGAGAACATTGCACTCACCCCACTATTTATCTCTATTCTTTCTCTATTACTGACCAA CATATCCTCTGTGCGCACCCTCGCGCGGAAACAACAACATCGTGTACACACCAAGAAGTAA GCACATGATTGCTAGCCTGGGACACCGCGCCCTCATAATATATA | SEQ ID NO: 1561 |
| RNPS1 | ADXCRAD_CX785467_at | GATCGGAATGCAAATCTAGTTCTGGGTTCACTGCCTTCTCACTT | SEQ ID NO: 2688 |
| RNPS1 | ADXCRAD_CX785467_x_at | GATCGGAATGCAAATCTAGTTCTGGGTTCACTGCCTTCTCACTTGTCCCCTCGCCCCTAGTAA CTTTCTGTTCCTCACCA | SEQ ID NO: 2689 |
| RNPS1 | ADXCRAD_NM_006711_at | AATAAACCCAAGATCATCTGAGATGAATATTAATTTTATTCTCATTTTATAGATGAGGAAATG GGAGTTTTAAAGACATTCAATAACTTTGGCCAAGGTCATTCAGCTATTAAATTTTAAGACCAT AAACCAATTGGATTCCTGGAGGAATTC | SEQ ID NO: 2859 |
| RPL13 | ADXCRIH.350.C2_s_at | GAATCAGTCGGCAGTCATGCTGGGTCTCCACGTGGTG | SEQ ID NO: 1273 |
| RPL13 | ADXCRAD_BM907731_at | TTTACACCACCCTCGTGGAATTGGCGAAAAAAACTGCCCGAGCTTGTGGGAAACTTTTTGTGG GAGAGGAACCCCTTACTTTTCGGGGGGGGGCGCACAAATTTGGTGACCAACCTCCGCCCCCC ACAGAATTTCGAGGCCCCCCGAGGGGACCAAAATAAACACTCTTCTCAGCCGACACATTGCGG CTAAAACAAACGCACCGACAAAATACCTTTCGCGCGGGTTGAGAACCATTTTC | SEQ ID NO: 2637 |
| RPL13 | ADXCRAD_AI554467_at | AGACAGGTTGTTAAACCCACATGCACCAAAGGGCAAGGGAACAACCAAGCGTCAGGAGAACCC GGAGGACCTCCCGGGGATTGGGGGTCAGGTTCGCTGCCATAAGTACTGCTGAAAAGCAACCCT GAGTCAATCACCTTCCCTG | SEQ ID NO: 2882 |
| RPL13 | ADXCRAD_AI554467_x_at | GCTTTCTCCTTCTTATAGACCTAGAAGAGAAAGACAGGTTGTTAAACCCACATGCACCAAAGG GCAAGGGAACAACCAAGCGTCAGGAGAACCCGGAGGACCTCCCGGGGATTGGGGGTCAGGTTC GCTGCCATAAGTACTGCTGAAAAGCAACCCTGAGTCAATCACCTTCCCTGGGATTTA | SEQ ID NO: 2883 |
| RPL13A | ADXCRIH.613.C1_at | AGCGGCCTGGCCTCGCTTGGTTTTGTGGGGCAGCATACCTCGCACGGTCCGCCAGAAGATGCG GCTGGGGGCCGGAAGTGGTAGGGGCCTCGGGAAGGGTTGGTGTTCATCCGCTTGCGGAGGAA AGCCAGGTACTTCAACTTGTTTCTGTAGAAATTGCCAGAAATGTTGATGCCTTCACAGCGTAC GACCACCACCTTCCGGCCCAGCAGTACCTGTTTAGCCACGATGGCCGCCAGGCGGCCCAGGAG ATGGCCTCGACCATCAAGCA | SEQ ID NO: 1280 |
| RPL13A | ADXCRIHRC.613.C1_x_at | GCTGCCCTCAAGGTCGTGCGTCTGAAGCCTACAAGAAAGTTTGCCTATCTGGGCGCCTGGCT CACGAGGTTGGCTGGAAGTACCAGGCAGTGACAGCCACCCTGGAGGAGAAGAGGAAAGAGAAA GCCAAGATCCACTACCGGAAGAAGAAACAGCTCATGAGGCTACGGAAACAGGCCGAGAAGAAC GTGGAGAAGAAAATTGACAAATACACAGAGGTCCTCAAGACCCACGGACTCCTGGTCTGAGCC CAATAAAGACTGTTAATTCCTCGTGCCGAA | SEQ ID NO: 1331 |
| RPL3 | ADXCRIH.445.CB1_s_at | CCTTGCTGGTGCAGACGAAGCGGCGGGCTCTGGAGAAGATTGACCTTAAGTTCATTGACACCA CCTCCAAGTTTGGCCATGGCCGCTTCCAGACCATGGAGGAGAAGAAAGCATTCATGGGACCAC TGAAGAAAGACCGAATTGCAAAGGAAGAAGGAGCTTAATGCCAGGAACAGATTTTGCAGTTGG TGGGGTCTCAATAA | SEQ ID NO: 1162 |
| RUVBL1 | ADXCRAD_CN389613_s_at | AAGAGCATGTCGAAGAGATCAGTGAACTTTTCTATGATGCCAAGTCCTCCGCCAAAATCCTGG CTGACCAGCAGGATAAGTACATGAAGTGAGATGGCTGAGGTTTTCAGCAGCAAGAGACTCCCC AGGTGTGCCTGGCCTGGGTCCAGCCTGTGGGCGCTTGCCCCTGGGCTTGGGCTGCCGTCCCC ACTCAGGCGTGGGCTGCAGCGCTGTCAGTTCAGTGTGGAAAGCATTTCTTTTTAAGTTATCGT AACTGTTCCTGTGGTTGCTTTGAAAGAACCCTTC | SEQ ID NO: 918 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| S100A14 | ADXCRIH.2777.C1_s_at | TGATTTGAATAATGGAGCTGGGAATATGGCTGGATATCTGGTACTAAAAAAGGGTCTTTAAGAACCTACTTCCTAATCTCTTCCCCAATCCAAACCATAGCTGTCTGTCCAGTGCTCTCTTCCTGCCTCCAGCTCTGCCCCAGGCTCCTCCTAGACTCTGTCCCTGGGCTAGGGCAGGGGAGGAGGGAGAGCAGGGTTGGGGGAGAGGCTGAGGAGAGTGTGACATGTGGGGAGAGGACCAGCTGGGTGCTTGGGCATTGACAGAATGATGGTTGTTTTGTATCATTTGATT | SEQ ID NO: 1140 |
| SERPINB1 | ADXCRIH.2353.C1_at | TTTGGAAGCCACAAAATAGACAGACACCCTGACTGTTGAAGGGAGGTTTAAAAACAGATATTCAATTGAAATGTAAGAGAGCACCTCAATTGAGAGCCCAGGTTACGAAGACAAGCTTGCCTCGCCTGACTTTTCTGTCCCTTGTTCTGCAGGATTAGTATTCTGTTACAGACTTCTAGTTTTAGACTCTTCATTAAAGGGCCAATGGTTATAACCTGC | SEQ ID NO: 1122 |
| SERPINB1 | ADXCRIH.2353.C1_s_at | ATCTATAAAATTGCTATATCCTCCTGATAGCCATGGGAAAACATGATAAGATGGTCATTTATTTTGCAGTTAGAATTTTGGAAGCCACAAAATAGACAGACACCCTGACTGTTGAAGGGAGGTTTAAAAACAGATATTCAATTGAAATGTAAGAGAGCACCTCAATTGAGAGCCCAGGTTACGAAGACAAGCTTGCCTCGCCTGACTTTTCTGTCCCTTGTTCTGCAGGATTAGTATTCTGTTACA | SEQ ID NO: 1123 |
| SERPINB1 | ADXCRAD_D11859_s_at | GGGCTCTTGGACTGATATAAAACTTTGTNAAATGTAGTTCTTTGAATGGAGCTTGAAACGCCGCATATNCTTGCTCCCACAAGGATAGTGGGCATCATGAATTAATAAAACGTCCTAGGATTCTGCA | SEQ ID NO: 2457 |
| SERPINB1 | ADXCRAD_W52010_s_at | AAGGTGCAGCCTGGGATTCAAGTTCAAGGGGCTGCGAAACTTCTATTACTCATCACTTTAGATATGAAAGCATTTTAAATGTTTTTTTAAATCCATTAAAAAAAAAAAAACCTCTGTTACTAATTGTTAGTTGCTTCTTGCAGGGTTATATCAGTTCCTAGCTTGAGGTTTTCCACGGGACTTTAAAACCTCAGCA | SEQ ID NO: 2834 |
| SHMT2 | ADXCRAD_BP384660_s_at | AACAAGACTTAGAAGGAGGGCCCAGGCACTTTCTGTTTGAACCCCTGTCATGATCACAGTGTCAGAGACGCGTCCTCTTTCTTGGGGAAGTTGAGGAGTGCCCTTCAGAGCCAGTAGCAGGCAGGGGTGGGTAGGCACCCTCCTTCCTGTTTTTATCTAATAAAAATGCTAACCTGCCCTGAGTTTCCATTACTGTGGGT | SEQ ID NO: 2559 |
| SHMT2 | ADXCRAD_CX788770_at | ACTGCCAAGCTCCAGGATTTCAAATCCTTCCTGCTTAAGGACTCAGAAACAAGTCAGCGTCTGGCC | SEQ ID NO: 2669 |
| SHMT2 | ADXCRAD_CX788770_s_at | TCAGCGTCTGGCCAACCTCAGGCAACGGGTGGAGCAGTTTGCCAGGGCCTTCCCCATGCCTGGTTTTGATGAGCATTGAAGGCACCTGGGAAATGAGGCCCACAGACTCAAAGTTACTCTCCTTCCCCCTACCTGGGCCAGTGAAATAGAAAGCCTTTCTATTTTTTGGTGCGGGAGGGAAGACCTCTCACTTAGGGCAAGAGCCA | SEQ ID NO: 2670 |
| SLC19A1 | ADXCRAG_U17566_s_at | GAAGTACGTCCCAGCCGGCCTCAGGGTCTAAGGAGCGCTAGTGCCTTGCCCACAGGTGCGGGACCATCTGATGTGATGTGAATACTCTTCCCACATACATTAAACACACTTA | SEQ ID NO: 1064 |
| SLC19A1 | ADXCRPD.7962.C1_s_at | GCCGCGGGCTTCGTGAAGATCCGCTGGGCGCGCTGGTCCAAGCTGCTCATCGCGGGCGTCACGGCCACGCAGGCGGGGNCTGGTCTTCCTTCTGGCGCACACGCGCCACCCGAGCAGCATCTGGCTGTGCTATGCGGCCTTCGTGCTGTTCCGCGGCTCCTACCAGTTCCTCGTGCCCATCGCCACCTTTCAGATTGCATCTTCTCTGTCTAAAGAGCTCTGTGCCCTGGTCTTCGGGGTCAACACGTTCTTTGCCACCATCGTCAAGACCATCATCACTTTCATTGTCTCGGACGTGC | SEQ ID NO: 1389 |
| SLC9A3R1 | ADXCRIH.2825.C1_s_at | TTTTGTTAAGAGTGCAGTATTGCAGAGTCTAGAGGAATTTTTGTTTCCTTGATTAACATGATTTTCCTGGTTGTTACATCCAGGGCATGGCAGTGGCCTCAGCCTTAAACTTTTGTTCCTACTCCCACCCTCAGCGAACTGGGCAGCACGGGGAGGGTTTGGCTACCCCTGCCCATCCCTGAGCCAGGTACCACCATTGTAAGGAAACACTTTCAG | SEQ ID NO: 1169 |
| STOML2 | ADXCRIH.3851.C1_at | CTGCCTCCGTTATGAGATCAAGGATATCCATGTGCCACCCCGGGTGAAAGAGTCTATGCAGATGCAGGTGGAGGCAGAGCGGCGGAAACGGGCCACAGTTCTAGAGTCTGAGGGGACCCGAGAGTCGGCCATCAATGTGGCAGAAGGAAGAAACAGGCCCAGATCCTGGCCTCCGAAGCAGAAAGGCTGAACAGATAAATCAGCAGCTGAGAGGCCAGTGCAGTTCTGGCGAAAGCCAAAGCTAAAGCTGAAGCTATTCGAATCCTGGCTGCAGCTCTGACACAACATAATGG | SEQ ID NO: 1187 |
| TMPO | ADXCRAD_CN272683_s_at | CTAGCTATAAGGCTATAATTGGAAATTTGTATTTTTTATTTACAGCAAAACATTTATTCAGTCATCCAGTTTGCTACCAAAATATGTTTTAGATAAGTGTGTGTATGTTTGTTTAGAAGTTAGAAATTGTAAACACTGGTCTTATGTTTCATTTGGATTCATTATTGCATTGTCTTGTTACCAGAAACAAATTTTGCCAGCTTTTTTGCCCTATATTTCCCAGCATAATTTGATTAGAAAGT | SEQ ID NO: 1061 |
| TMPO | ADXCRIH.3127.C1_at | GAAATTGTGAGAAGCTTCATTTAGTGTTTAAAAATGTGGGGAGATAAATCAGACTTAACATGTATGTAAGATCAATTCACTTAAAAGTATGGTCCAAATAGCAAAAATAGGACCAGGTGAAACATGTAGTCATTTTTTAAAAACATGTACTTGGTCTTTTGTGTGTGTCTGTTTTTATTCCATTAGAATAAATGTGCCTTGATGTAATGCAAAGCATTTCTTCCTGATTAAATTGTAGATGTAGACTTTAC | SEQ ID NO: 1197 |
| TMPO | ADXCRIH.3127.C1_x_at | TCCCATACTGTTTTCAGCCTTTTGTTTATAATTAGAAATTGTGAGAAGCTTCATTTAGTGTTTAAAAATGTGGGGAGATAAATCAGACTTAACATGTATGTAAGATCAATTCACTTAAAAGTATGGTCCAAATAGCAAAAATAGGACCAGGTGAAACATGTAGTCATTTTTTAAAAACATGTACTTGGT | SEQ ID NO: 1198 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| | | CTTTTGTGTGTGTCTGTTTTATTCCATTAGAATAAATGTGTCCTTGATGTAATGCAAAGCATT TCTTCCTGATTAA | |
| TMPO | ADXCRIH.994.C1_s_at | ATATCCTGGGATAGTGCATGTTCACCATCTATTTTGTCAGATAATGGGGCCTTTTAAAAAATA ATACTTTGCTTTCATGATATATTGTATTTTTGTGGAAAGTTAAGTTTAGCAATATATACTCTA AAAGCAAATTTAATTTTTTTTAAGCCATAAAGAAATTATACTATATCCCAGTATCTGTATGTC TGTATAAAGCAGTGTATTATC | SEQ ID NO: 1247 |
| TMPO | ADXCRIHRC.3127.C1_at | TGAAATCAAAATTGTGTGCTGGTCTAAATATACATCTTCGGCTTCTTCCTTTTTAGTAAGTAT TTTTATTTCAGATGTATTTAAAAATAACTTACATTTTTAGTGTGCTTTATGGTCAATGACTGT AAAGTTGAAACTCAAATGAGTCAGTTTAAAATTTTTGTCTCATTTGATTCTATTGAAATTTTA ATCACCTACTACTTTAATCAAGTTATTCATGAGGTAAGTTTCAGCT | SEQ ID NO: 1320 |
| TMPO | ADXCRPD.3658.C1_at | TTGTTCACAGTGTTGGCACATGGTAAGGGCTAAGACACTTGATTAGCATAATATTCAAAATTA GAATTGTACACTATTGTACTCTCTTTCAAAAGGCAAACAGCCTAAACAGCCTAAAACTGTTTGGAAAAAAC AGCTTGTACAGTATATTGTACACTTCCTGTGATAGACTAGTGGACTGATACACCCACTAATGC ACAGCAGTAATAGTCCACCTCTTTACACANTTATGCATGTTAAGTGACAAAAAAACTCACTTT AAAAGGCCAAATGATAAAAACATCAGCCTTGAGGCTCTTCGATATAGA | SEQ ID NO: 1615 |
| TMPO | ADXCRPD.12957.C1_at | TAAACATGCAAACTCACTACCAAATTGGCTTATAGTAATATTAGGCCTTAGCAATTCCATTAA ATTAAGAGCAACTCATTATTGGAGAACACTTTCTAAGTTGAACTGTAATCATACAAACCGCAC AGCCAAGCAAGTAACTTAAAGACATTGTTGTTAAAATAGTCCATTTTGGATTACCTATCTAAA | SEQ ID NO: 1676 |
| TMPO | ADXCRAD_BX482009_s_at | AAAAGGGACGCTCCATTCCCGTATGGATAAAAATTTTGCTGTTTGTTGTTGTGGCAGTTTTTT TGTTTTTGGTCTATCAAGCTATGGAAACCAACCAAGTAAATCCCTTCTCTAATTTTCTTCATG TTGACCCTAGAAAATCCAACTGAATGGTATCTCTTTGGCACGTTCAACTTGGTCTCCTATTTT CAATAACTGTTGAAAAACATTTGTGTACACTTGTTGACTCCAAGAACTAAAAATAATGTGATT TCGCCTCAATAA | SEQ ID NO: 2649 |
| TPK1 | ADXCRAD_CD511474_at | TAAAATGGAAGCGGTTGGACTGATGGTGTCTGAGGTTCTTTCCCACACTGAAATTCTAAATAT TGACACTTAGCAGTCATAGGGCTGATAATACACACAGTTACTGACTTAGCCTAAACAACCTGG TGCATCGAAATGTAATCACCCTTTCTTTTGTAAAAGAGACCCATCTTCTATCTTCCTTTCCCA CCTTTTCTCTGTTTTTATGAAAACCCAACTGTTGGACATTCCAAACCATTGGATTTGA | SEQ ID NO: 2381 |
| TPK1 | ADXCRAD_CD511474_s_at | ATTGACACTTAGCAGTCATAGGGCTGATAATACACACAGTTACTGACTTAGCCTAAACAACCT GGTGCATCGAAATGTA | SEQ ID NO: 2382 |
| TPK1 | ADXCRAD_CD511474_x_at | CATCCCAGTCTGATATTCACCTAAGTTTCCGGACCCTTTTCCTTAGCTGTAAAATGGAAGCGG TTGGACTGATGGTGTCTGAGGTTCTTTCCCACACTGAAATTCTAAATATTGACACTTAGCAGT CATAGGGCTGATAATACACACAGTTACTGACTTAGCCTAAACAACCTGGTGCATCGAAATGTA ATCACCCTTTCTTTTGTAAAAGAGACCCATCTTCTATCTTCCTTTCCCACCTTTTCTCTGTTT TTATGAAAACCCAACTGTTGGACATTCCAAACCATTGGATTTG | SEQ ID NO: 2383 |
| TPK1 | ADXCRAD_CR745173_s_at | TGGCCCGCGTGATTGTGGCATTTAAGGAGCAGTGGCCCATGTGACTGTGGCATTTTCGGCACT TTTCATTACTTTCTGCTTGACCGGAAGTTGAGGCTTAGCTATGTTTCCATCTTCAGTTTCTGA AGACTAGTTATATATTCCTTACTAGAAATATATTCATAATATATAAAGAAATATATCTGTGA TTTTAAAATTTTGCTACCAAAGAATGCATGTTCTGTGTGCCCTGAAAATGTTAC | SEQ ID NO: 2592 |
| TPT1 | ADXCRAD_NM_017627_s_at | GGGACTGATGTCATCTTGAGCTCTTCATTTATTTTGACTGTGATTTATTTGGAGTGGAGGCAT TGTTTTTA | SEQ ID NO: 1167 |
| TPT1 | ADXCRIH.18.CB1_x_at | ACTCATCAATTAACTTCTACAGTGGAGACTACTTCTGGGACTGGAATATAAAAAAGAATCAAA GGTTCTGATTTTGAGTTGCAATAAAGGGAAAGACCATGCTCATAGCAGTGCCAACATCTGAAG TGTGGAGCCTTACCCATTTCATCCACCTACAACGGAAGTAGTTAACTGGAAGAGATTACCAAGA GAATAAAAAGAGACTCATTCAGTGGAACCAACCTCGTGCAGCCCGGG | SEQ ID NO: 1168 |
| TPT1 | ADXCRPD.14624.C1_at | CCAGCTGGAGTTTTTGGGACGCTTTTGTGGGGGCACCGCTGAGTCCGGATAGTGGGACCCAAG TCGTCCTGCTCGGCCCCTGGGGAATAATCGTGTGGGGCGCAAGGTCTGTGGGAAGGGACTTGG AGAGGAGGGAAGATGTCGCGGGAGTCTGCACAGGGTTTCCATGTGTTCCAATTCTTCGTCCCA TAATTCAAAGCTCGTGGCATTCTGTGGCCGACCGCTACCGAGCTAGCTCTTCCCTTTACTATT TCGCACTTGGTCTTGGAAAAGAT | SEQ ID NO: 1733 |
| TPT1 | ADXCRPDRC.14624.C1_at | TTATGGGACGAAGAATTGGAACACATGGAAACCCTGTGCAGACTCCCGCGACATCTTCCCTCC TCTCCAAGTCCCTTCCCACAGACCTTGCGCCCCACACGATTATTCCCCAGGGGCCGAGCAGGA CGACTTGGGTCCCACTATCCGGACTCAGCGGTGCCCCCACAAAAGCGTCCCAAAAACTCCAGC TGGGGCAGCCCTGGGGCCGATGCTGAAAAGTTGTCAGAGGCCCTCGGGCAGTCCCGAGATCTA CCCCAGGCCAGAGGGCCTGACCCTCCCTAAATGCGACGTTCT | SEQ ID NO: 2009 |
| TPT1 | ADXCRSS.Hs#S2979085_at | GGGTGCAGCACAAGTTCCTTCATAGGACTTTAAGACTCTTTGGGATCTAGTCCCTGCGTATCT CTCCAGTTCTCCTTACCATTCTCCTGTATCTGCCTCTGGCTGCAGCTGTGCCACAGCCAGACT CTGGAAGGAGCCTCTTGCTGTCAATTATCCAACAAGTGTTTACTGGGTACCCACTTCTGCCAG GCACTGGGTTAGAGGTTGGAGACATAGCAGTAAAGACTTGCTCTAGTGGAAGACAA | SEQ ID NO: 2143 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| TPT1 | ADXCRSS.Hs#S3017795_at | ACTACTCCAGATTTTTCACCTGCAAGTGGTAAGTCAGGCCAACTTCCGTTGGTGACCCGTTAT CTCTGCTTGAAAAAGATAAGGAGATTCTCCACTTTGGCCTCAGCTCTTAGCTAGGTTCTTTA GTCCAGCTAGGAGTTACTGAGCCTCCACCAAGAAGGTGAATCATTTGACCTCATTTAGCTCCT CCTCCTTATTTATCTTTATTAGAGCTTGCAGTGATGGAGAGTAAGTGATTGGGACCTCAAACT TCTAACACATAATTCTCTCAGGCGGGTTTGGAATGGTACTCTA | SEQ ID NO: 2175 |
| TSPAN8 | ADXCRIH.257.C1_at | CTATGGTCCTGTATTGCCAGATCGGGAACAAATGAATCTGTGGATGCATCAACCTATCGTCAG TCAAACCCCTTTTAAAATGTTGCTTTGGCTTTGTAAATTTAAATATGTAAGTGCTATATAAGTC AGGAGCAGCTGTCTTTTTAAAATGTCTCGGCTAGCTAGACCACAGATATCTTCTAGACATATT GAACACATTTAAGATTTGAGGGATATA | SEQ ID NO: 1298 |
| TSPAN8 | RDCR023_G12_at | AGTTGAGAGGCAGATACATTAAAAACCACTATAAATCACAATGAATTAATATTAATATCTATA ATACCCGAAGATTCTTTTCAATCTAGAAATGTTTTGGTTTAGTAACTGCTACTGAAAATAATT TATAAAAGGAAATAGAAAGTATCTCAGGGGAAACTACCCTTTCCTTGACTACTGATCTTTTTC ACTGATCTTATCAAAATTAAAGAGGCTCTGCCCTGAAGGGGAATTGCTGTCATTAATACTTAA AGTATGTCGCTAAGATTTAAAGTAACTCAA | SEQ ID NO: 1342 |
| TSPAN8 | RDCR023_G12_x_at | GAGGCAGATACATTAAAAACCACTATAAATCACAATGAATTAATATTAATATCTATAATACCC GAAGATTCTTTTCAATCTAGAAATGTTTTGGTTTAGTAACTGCTACTGAAAATAATTTATAAA AGGAAATAGAAAGTATCTCAGGGGAAACTACCCTTTCCTTGACTACTGATCTTTTTCACTGAT CTTATCAAAATTAAAGAGGCTCTGCCCTGAAGGGGAATTGCTGTCATTAATACTTAAAGTATG TCGCTAAGATTTAAAGTAACTCAA | SEQ ID NO: 1343 |
| TSPAN8 | 1_RDCR049_C08_at | TTTTTATTCCTCTTGGAAATGCCTAAAACTACAGCAAGAGAAATTCTAGACTTCTGGATTTTT ATGCAGATGATTTAAACCAGATGATCATAACCTTTTTATGGAAGCAGTACGTATATTTAGCCC CCAGGGACCTGAGATCCCCAGTGCTCCAGAGGAGACGCTCTGCAGAAGAATGTGTGTGTTCCA GAAAAGGGAGTAGGTCCTCTGGTGGCAGCTGCTACTGTGCAGTTTATATGGGGCCAGTTAGAT AGAGGCTGATTGGCC | SEQ ID NO: 1355 |
| TUFM | ADXCRIH.1094.C1_s_at | TAGAGAAAGGCCAGCGTTTCACCCTGCGAGATGGCAACCGGACTATTGGCACCGGTCTAGTCA CCAACACGCTGGCCATGACTGAGGAGGAGAAGAATATCAAATGGGGTTGAGTGTGCAGATCTC TGCTCAGCTTCCCTTGCGTTTAAGGCCTGCCCTAGCCAGGGCTCCCTCCTGCTTCCAGTACCC TCTCATGGCATAGGCTGCAACCCAGCAGAGGGCAGCTAGATGGACATTTCCCCTGCTCGGAAG GG | SEQ ID NO: 1146 |
| TXN | ADXCRIH.324.C1_s_at | AGTCAAATGCATGCCAACATTCCAGTTTTTTAAGAAGGGACAAAAGGTGGGTGAATTTTCTGG AGCCAATAAGGAAAAGCTTGAAGCCACCATTAATGAATTAGTCTA | SEQ ID NO: 1124 |
| TXN | ADXCRPD.10055.C1_at | TTTTTCCTGTCTTACCTGGATCTTGCAATAAAGGATGCCTGGTTTAATTTTCTTGAAAATCAC ATTAGGGAAGGCTTTGAATGAAATTGATCTGGAACAATAAGTGATGATTTGGAAAAACAATTG CTATACTTCTATGTAACCTGCTGCAGCTCTCCCCATGTCTCCACCTCTAGAGGTGGGGTTCAG GGAGTTTGCATAACTAAAAAATTTATGAAAGTGTTGTCCTACCTTTCTCAGGAACACCATTTGT GAATTATTTTCCCAAATATCGAGGGAGGTGATCTTCT | SEQ ID NO: 1842 |
| UCK2 | ADXCRPD.10643.C1_at | AAGATTAGATTCCTGCCTCGGGCCAGGTGAAAGGAAGGCAGGAAAGAGATTCTGTTTCCTGAC CCAACATTATCACAAAAGACTGTAACAAGGGCTGTGGGAGTTATGGACCAGGAACCTGGTTGA AAACCATTATAAATCATAACACCACAAGGACCTATATTTTGCTTTTTAGGACATTGTAGTAGG TGGGTAGTTTTCATCCTCTTGCTTTTTAAAATCTATCTTGCCCAGAAGTTTATTGGGCATTTC TATGGAAACACAACACCTCTCTTAAAT | SEQ ID NO: 1461 |
| UCK2 | ADXCRPD.9879.C1_s_at | GCAGGCCGCATTGACCCGTCTCCATCGGACCCCAGCCCCTATCTCCAAGAGACAGAGGAGGGG TCAGGAGGCACTGCTCATCTGTACATACTGTTTCCTATGACATTACTGTATTTAAGAAAACAC CATGGAGATGAAATGCCTTTGANNNNNNNNNNNNNNNNNNGTACTTTGGAACGACAAAATGAAAC A | SEQ ID NO: 1541 |
| UCK2 | ADXCRPD.5097.C1_s_at | ACTGGCATTCCAGGTCAGCTTGGCTGTGGTCTTAGAGGCAGGGAGTGCCTACCCAGTCCTGCC TCAGGAGCAGGGTGAGTAGCTAAATACAGACTTAGGCTTTTTTTCCCCCCTTTTAAGATGCTT GCTCCTCTCCCTTTTCTTTTTACCACCCTACCTTTATTGTTAGTGGTTACAAAGTGACCACAT ATTATGTACTTTGCTGTAA | SEQ ID NO: 1651 |
| UCK2 | ADXCRPD.14415.C1_s_at | TAGCGGCAAGTCTTCCGTGTGTGCTAAGATCGTGCAGCTCCTGGGGCAGAATGAGGTGGACTA TCGCCAGAAGCAGGTGGTCATCCTGAGCCAGGATAGCTTCTACCGTGTCCTTACCTCGGAGCA GAAGGCCAAAGCCCGGAAGGGCCAGTTCAACTTTGACCACCCGGATGCCTTTGACAATGAACT CATTCTCAAAACAC | SEQ ID NO: 1702 |
| UCK2 | ADXCRPD.15116.C1_at | CCCCTCTGCCAGACAGTGGGTTGAACACACATGTACACCTGAGGAGGAGGGTCTGACGAGGGC TGCCTCAGAGTCAGAGGCAGCAGGACTAGCTCTGTATGTTCGACCTCATGTCTGGCCCATCTT GAGTCCCAGGCTCATACAAAATCACCTGTGTTCAGATACAGATTCAACTCAGTATTTAATGAG CCAAGCACTACTTGAAGCATCTTGACAGTCCTTCTCTTCACATAAGCCCCGACAATCACATCT GCAAGGTACGTATCAAGTCCCTACGTTCCGAGACA | SEQ ID NO: 1715 |

TABLE 7-continued

Genes and corresponding Almac probesets predicting sensitivity to 5-FU. There can be multiple Almac IDs/probesets associated with a given gene.

| Gene | Almac Probe ID | Probe Sequence | SEQ ID NO |
|---|---|---|---|
| UCK2 | ADXCRPD.14599.C1_at | TTAAACTCCACCAAGACCCAGCAAGAAGAGCCTCATGGCAGGCTAGGACTGAGTTCTTCCCAG AAGCAGGTCTAAAACACAAGCTTTTCCACCTTAACAATGGATGTCTCCTGACCCCTTCCTCC AGAAATCAAATGGCCAATCTGATGCCCACTTCAGCTTCTGTCATCCCTCTGTAGTCAGACAAG GAGGGCTCGCTCAGCTTGCATTTCCTTCCTGAAGAGTATTCACTACCTCTCTTGTTCAAACAC TATGTATCACTCAAT | SEQ ID NO: 1728 |
| UCK2 | ADXCRPDRC.5097.C1_at | GCAAAGTACATAATATGTGGTCACTTTGTAACCACTAACAATAAAGGTAGGGTGGTAAAAAGA AAAGGGAGAGGAGCAAGCATCTTAAAAGGGGGGAAAAAAAGCCTAAGTCTGTATTTAGCTACT CACCCTGCTCCTGAGGCAGGACTGGGTAGGCACTCCCTGCCTCTAAGACCACAGCCAAGCTGA CCTGGAATGCCAGTCCCCGGTATGAGGAAGGCAGC | SEQ ID NO: 1983 |
| UCK2 | ADXCRPDRC.5097.C1_x_at | GCCTTTTTGTCTGTCTTTATTTACAGCAAAGTACATAATATGTGGTCACTTTGTAACCACTAA CAATAAAGGTAGGGTGGTAAAAAGAAAAGGGAGAGGAGCAAGCATCTTAAAAGGGGGGAAAAA AAGCCTAAGTCTGTATTTAGCTACTCACCCTGCTCCTGAGGCAGGACTGGGTAGGCACTCCCT GCCTCTAAGACCACAGCCAAGCTGACCTGGAATGCCAGTCCCCGGTATGAGGAAGGCAGCAGA ACGCCCAGAGACA | SEQ ID NO: 1984 |
| USH1C | ADXCRIH.2211.C1_s_at | ACCAGGGCCAGATAAGGAACAGCTCGGGCCACTCTTCTGAAGGCCAACGTGGAGGAAAGGGAG CAGCCAGCCATTTGGGAGAAGATCTCAAGGATCCAGACTCTCATTCCTTTCCTCTGGCCCAGT GAATTTGGTCTCTCCCAGCTCTGGGGGACTCCTTCCTTGAACCCTAATAAGACCCCACTGGAG NNNNNNNNNNNNNNNNNNNNNNNNNNNNNNNNNNNNNNNNNNNNAATTGCTGCCAGGATTGTCACTCCA | SEQ ID NO: 1242 |
| USH1C | ADXCRPD.18376.C1_s_at | GTCCATCAAAGTGAGACACATCGGCCTGATCCCCGTGAAAAGCTCTCCTGATGAGCCCCTCAC TTGGCAGTATGTGGATCAGTTCGTGTCGGAATCTGGGGGCGTGCGAGGCAGCCTGGGCTCCCC TGGAACATCGGGAAACCAAGGAGAAGAAGGTCTTCATCAGCCTGGTAGGCTCCCGAGGCCTTG | SEQ ID NO: 1421 |
| USH1C | ADXCRAD_NM_025034_at | ACATGCACACATAGGATTTTACTTGAAAAAAATAATAAAGGAGACAGATATGTCAAATCTTTT TCAGGCACTAATAACATGTAAATGTAAAAGAACTAGAATCTTCTCCACATACCACCTCCCATC AGAAATCATGTCCTTGAAAGTGCTGTTGATAAAGAAATAGGGTTGCCTTTCCCCTATTCCTTA ATCTAATTATTCCAGAAACAGCTGTCATTTTGGTTTTCATT | SEQ ID NO: 2848 |
| WDR59 | ADXCRPD.15558.C1_s_at | CAGTGTTACCCTGTAAGGTGTTAGCCTTAAACCACCGAGCAGCGTTCTCTTGATGCCAGTGCA GAGACCAGAGTCAGATGCCCGAGGACAGTGGGTAGGAATTTCATCAACAAATGGACCTATGGC ATCATGGCTTTAGAAGCTGGTACATTTACTGAGCTGATGGACAGTGGCCTTCTAAAATATGAC ACTTAAATTGTAAATATGCACTGTACTTAAGGATTCTTAAGATGTATTTTTTGTTATTCTC CTCCAGCTGCTATCCCTTGGCTAATAAA | SEQ ID NO: 1764 |
| WDR59 | ADXCRAD_AA393120_at | CCCCTAGAAATCTCCTGGAAGAGAGGAAATCAGATCAACTGGGGCTGCCTCAGACCTTGCAGC AGGAATTCTCCCTGATCAATGTGCAAATCCGGAATGTCAATGTGGAGATGGATGCGGCAGACA GGAGCTGCACAGTGTCTGTGCACTGCAGCAACCATCGTGTCAAGATGCTGGTGAAGTTCCCTG CACAGT | SEQ ID NO: 2596 |
| ZFP36 | ADXCRIH.2153.C1_s_at | GGGAATCCTGGTGCTCAAATTACCCTCCAAAAGCAAGTAGCCAAAGCCGTTGCCAAACCCCAC CCATAAATCAATGGGCCCTTTATTTATGACGACTTTATTTATTCTAATATGATTTTATAGTAT TTATATATATTGGGTCGTCTGCTTCCCTTGTA | SEQ ID NO: 1194 |

TABLE 8

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| ACTN1 | ADXCRAD_BM714793_at | AAGAGAATTTATGTGGCTTCTCATTTTTAAATCCCCTCAGAGGTGTGACTAGTCTCTTTATC AGCACACACTTAAAAAATTTTTAATATTGTCTATTAAAAATAGGACAAACTTGGAGAGTATG GACAACTTTGATATTGCTTGGCACAGATGGTATTAAAAAA | SEQ ID NO: 2737 |
| ACTN1 | ADXCRAD_CX871590_s_at | TCTCCTGCCTGGGTTCGGTTTCAGCTCCCAGCCTCCACCCGGGTGAGCTGGGGCCCACGTGG CATCGATCCTCCCTGCCCGCGAAGTGACAGTTTACAAAATT | SEQ ID NO: 2469 |
| ACTN1 | ADXCRAD_M95178_at | GACGTCAGCCTGTACAGGCTCCCAGGGGTGGCGTCAAATGCTATTGAAATTGCGCTGAATCG TATGCTTTTTCC | SEQ ID NO: 2816 |
| ACTN1 | ADXCRAD_M95178_x_at | GTGCGCCGTGCCCACAGATGTGAAATGAATGTAATCTAATAGAAGCCTAATCAGCCCACCAT GTTCTCCACTGAAAAATCCTCTTTCTTTGGGGTTTTTCTTTCTTTCTTTTTTGATTTTGCAC TGGACGGTGACGTCAGCCTGTACAGGCTCCCAGGGGTGGCGTCAAATGCTATTGAAATTGCG CTGAATCGTATGCTTTTTCCTTTTGA | SEQ ID NO: 2817 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| ACTN1 | ADXCRAG_BC011987_s_at | GGAAAGATTAACTATTTGCACCGAAATGTCTTGTTTTGTTGCGACATAGGAAAATAACCAAG CACAAAGTTATATTCCATCCTTTTTACTGATTTTTTTTCTTCTATCTGTTCCATCTGCTGT ATTCATTCTCCAATCTCATGTCCATTTTGGTGTGGGAGTCGGGGTAGGGGGTACTCTTGTC AAAAGGCACATTGGTGCATGTGTGTTTGCTAGCTCACTTGTCCATGAAAATATTT | SEQ ID NO: 934 |
| ACTN1 | ADXCRSS.Hs#S3748482_at | GGCACAGAGGAAACCCGCTGAGCCTGCTTCCTTAGTTCTGGCAGATGGGTCAGCCCCCACAG GACTCAGGATTCAATTTAGCCCGGGGTTCTGGCTCCATCTCCCACAGTGCCGGTGCCAGTGT GCTCCTAAGTACTGTTTGTGCAAACCTGGCTCTGACTGAGACAAGGAGCCTTAGGAGTAGTA GGGACAGGAGACACAGCAAACTAGGGCTCAGA | SEQ ID NO: 2203 |
| ATM | ADXCRAD_BU501514_s_at | ATACAGCAGGCCATAGACCCCAAAAATCTCAGCCGACTTTTCCCAGGATGGAAAGCTTGGGT GTGATCTTCAGTATATGAA | SEQ ID NO: 2467 |
| ATM | ADXCRAD_N29457_at | GCCAGTTCTCCGCAGTGAAATGCTAGGAAAATGTCTTTAGAAGACAGAATTCTTTCTGAATG CAAGTCTAAAATGCTTAAAAGAGATTAAAGGTTTTAAAGACCCAAATCAGAAATATCCATTA GATACATCTCATTTGAATCCTAAGAGTTTAAACATAATAAACGCTGTATTTATTTATTTTAT TTCTTTTTATTTTTTTGAGGCAGAGTCTCACTTTGTTGCCCAGGCTGGAGTGCAGTGGTGC AGTCTTGGCTCACTGCAGCCGTGTCTTCTGGGTTAAAACGATTCTC | SEQ ID NO: 2812 |
| ATM | ADXCRAG_U67093_s_at | TTGGTCATTATAGTATATGCCTAAAATGTATGCACTTAGGAATGCTAAAAATTTAAATATGG TCTAAAGCAAATAAAAGCAAAGAGGAAAAACTTTGGACATCGTAAAGACTAGAATAGTCTTT TAAAAAGAAAGCCAGTATATTGGTTTGAAATATAGAGATGTGTCCCAATTTCAAGTATTTTA ATTGCACCTTAATGAAATTATCTATTTTCTATAGATTTTAGTACTATTGAATGTATTACTTT ACTGTTACCTGAATTTATTAT | SEQ ID NO: 1071 |
| ATM | ADXCRPD.14974.C1_at | ATTTGTTAATCCTCCGCAGCTGGGATGAACATTTTCCTAAGGATGGAGAAGAGATAATACTC ACTAATACACGAGTCAGTAGTTTTACTTTCAGGTGGCTTTTAATCTGATGTTTATCTAATAT GATGACAGCTGGGGGACAGAGAAATGTTCCACTTCTACCTATGTATCAAACTAGATACCTAA GCCCTTCC | SEQ ID NO: 1768 |
| ATM | ADXCRPD.3071.C1_s_at | ATTTGGGACTCTGCCATATTCTTTCCGTCTATTTAAAAGGATTGGATTATGAAAATAAAGAC TGGTGTCCTGAACTAGAAGAACTTCATTACCAAGCAGCATGGAGGAATATGCAGTGGGACCA TTGCACTTCCGTCAGCAAAGAAGTAGAAGGAACCAGTTACCATGAATCATTGTACAATGCTC TACAAT | SEQ ID NO: 1493 |
| ATM | ADXCRPDRC.14974.C1_s_at | AACTACTGACTCGTGTATTAGTGAGTATTATCTCTTCTCCATCCTTAGGAAAATGTTCATCC CAGCTGCGGAGGATTAACAAATGGGTGATTGAGCTTTCTCCTCGTATTTGGACCTTGAAGGT TATATAAATTTTTTTCTTATGAAGAGTTGGCATTTCTTTTTATTGCCAATGGCAGGCACTCA TTCATATATGATCTCCTCACCTTCCCCTCCCCTAAAACCAATCTCCAGAACTTTTTGGACTA TAAAT | SEQ ID NO: 2017 |
| ATM | ADXCRSS.Hs#S11049845_at | CCTTGTTTGCCTTGGTATCATTCAGCGGAGGCTGCAGAACAGCAAAGATTGCTATCTGTTCC TTCCTCTGGAAGCTTCGTCCCAGAGGGGAATGCGCCAGATGCCTGCTGGAGCTCTCCTGTAT GTGGTGTCTGTCGACCCCTGCTGGGAGGTGTCTCCCAGTCAGGAGGCACGGGGGTCAGGGAT CCACTTGAGGAGGCAGTCTGTCCCTTAGTAGAGCTTGAGCGCTGTGTTGGGAGATCCAA | SEQ ID NO: 2084 |
| ATM | ADXCRSS.Hs#S11049845_x_at | CCTTGTTTGCCTTGGTATCATTCAGCGGAGGCTGCAGAACAGCAAAGATTGCTATCTGTTCC TTCCTCTGGAAGCTTCGTCCCAGAGGGGAATGCGCCAGATGCCTGCTGGAGCTCTCCTGTAT GTGGTGTCTGTCGACCCCTGCTGGGAGGTGTCTCCCAGTCAGGAGGCACGGGGGTCAGGGAT CCACTTGAGGAGGCAGTCTGTCCCTTAGTAGAGCTTGAGCGCTGTGTTGGGAGATCCAAGGA GCTGGCAGGCAGGAACGTTTAAGTCTGTTGAGGCTGCACCC | SEQ ID NO: 2085 |
| ATP2B4 | ADXCRAD_BQ223439_s_at | CCCCATTCAGGTCATGGTAGAATCTACTCCTTGGTAGTCACTTGTCATTTTTANAGAAATGA TGACAATCCTCTTGGCATCACCCCACCCCACATTCTCCCCGATGGTCCTCTCCTGAATTCTG GATTTTGTCCTACAAGTCTGTGCCATTTATAA | SEQ ID NO: 2627 |
| ATP2B4 | ADXCRAD_CN299966_at | ACAAATGGTGATATCAAAGCAACGTATACCCCAGTCCAGTGTGTGTTGCCATAATTTGCAAT TCAGCTTAACAGTGCACCCAATCTATATTTGCATTTTG | SEQ ID NO: 2523 |
| ATP2B4 | ADXCRPD.10094.C1_at | AGCCATCTTTATACTTAGGGAAGAAAAATTGTTGGGTTCTAGACTTTTTAATATAAATTTT GTTGATATGGAATTAGGTAAGTTTAAGTGTCTATGTGCATATGTTTTTATATAAGTTTTTTC TATTCAGTTTCACTGATCCAACTGGCAGTGGGTAAATATGGCATAAGTTAATAACACTTTTC CCCAAAATGGTGCTTTGGATTTGAAAAGGGTCTGATGGGAGAAGGAGAACGTATCATCCTA GCTTCCTCTCTTATAAACCTAGAAAAACGGGTAGTAAACTGTGGATAGTCA | SEQ ID NO: 1845 |
| ATP2B4 | ADXCRPD.11491.C1_at | TTCATTTTTCTTCCCCTCTGCTAGTTTGGAAGTTATATTATACCAAGTTTTTTAGTATTAGC CTAGAAATCTTAACATAAAGACTTCTAATAAGCAATATCTTTAATTTTTTTNCCTACCCAA TACTAGATCATGAGCATTTTCCCACATCATAAAGAATTGGTCACAAGTCAGCCCCAAACATA GTCCAGTGGAATCCAATGATA | SEQ ID NO: 1498 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| ATP2B4 | ADXCRPD.5728.C2_at | ATGGGAGCTCATCTCCTTCCATCTCTCCTAATCAAGAGCAAAGGGAACAGCAGGCCTAACAG CAGGGTTGGGAAGGCAAA | SEQ ID NO: 2284 |
| ATP2B4 | ADXCRPD.5728.C2_x_at | CAATAGTCAATCTTTGGTTTTTCTTTTTGGTACAAAAATACCAGTGCTTGTTATACTAGTTA CTAAAAGAAGAAGAAACTCAAAATTCCTATCTGCGTGCTAATTTGAAAAGAACAACGTAGAT AGATTTGTTGGCACATATATATGGCATATTCACATATGGCATATATACATATGGGGAGAAAA CATGAACCAAAGGCCAATTCAGTTATGGGAGCTCATCTCCTTCCATCTCTCCTAATCAAGAG CAAAGGGAACAGCAGGCCTAACAGCAGGGTTGGGAAGGCAAA | SEQ ID NO: 2285 |
| ATP2B4 | ADXCRPDRC.5728.C1_s_at | TGGAAGGAGATGAGCTCCCATAACTGAATTGGCCTTTGGTTCATGTTTTCTCCCCATATGTA TATATGCCATATGTGAATATGCCATATATATGTGCCCACAAATCTATCTACGTTGTTCTTTT CAAATTAGCACGCAGATAGGAATTTTGAGTTTCTTCTTCTTTTAGTAACTAGTATAACAAGC ACTGGTATTTT | SEQ ID NO: 2056 |
| AXL | ADXCRAD_NM_021913_s_at | GTTCTAACCCTATACTGTAGTATTCTTGGGGTGCCCCTCTCCTTCTTAGCTATCATTGCTT CCTCCTCCCAACTGTGGGGGTGTGCCCCCTTCAAGCCTGTGCAATGCATTAGGGATGCCTC CTTTCCCGCAGGGGATGGACGATCTCCCACCTTTCGGGCCATGTTGCCCCCGTGAGCCAATC CCTCACCTTCTGAGTACAGAGTGTGGACTCTGGTGCCTCCAGAGGGGCTCAGGTCACATAAA ACTT | SEQ ID NO: 1586 |
| C19orf10 | ADXCRIH.3832.C1_s_at | AGAGAACAGAGGGTCCAGGGCCCTCCTGGCTCCCAACAGCTTCTCAGTTCCCACTTCCTGCT GAGCTCTTCTGGACTCATGATCGCAGATCCGGGGCACAAAGAGGGTGGGGAACATGGGGCT ATGCTGGGAAAGCAGCCATGCTCCCCCGACCTCCAGCCGAGCATCCTTCATGAGCCTGCAG AACTGCTTTCCTATGTTTACCCAGGG | SEQ ID NO: 1178 |
| CALU | ADXCRAD_BP380290_s_at | GAATGCTGATGGTTTCATTGATCTAGAAGAGTATATTGGTGACATGTACAGCCATGATGGGA ATACTGATGAGCCAGAATGGGTAAAGACAGAGCGAGAGCAGTTTGTTGAGTTTCGGGATAAG AACCGTGATGGGAAGATGGACAAGGAAGAGACCCAAAGACTGGATCCTTCCCTCAGACTATGA TCATGCAGAGGCAGAAGCCAGGCACCTGGTCTATGAATCAGACCAAAACAAGGATGGCAAGC TTACCAAGGAGGAGATCGTTGACAAGTATGACTTAT | SEQ ID NO: 2344 |
| CALU | ADXCRAD_CN403921_s_at | GATAATTTAATAATGCCACCAACTCTGGCTTAGTTAAGTGAGAGTGTGAACTGTGTGGCAAG AGAGCCTCACACCTCACTAGGTGCAGAGAGCCCAGGCCTTATGTTAAAATCATGCACTTGAA AAGCAAACCTTAATCTGCAAAGACAGCAGCAAGCATTATACGGTCATCTTGAATGATCCCTT TGAAATTTTTTTTGTTTGTTTGTTTAAATCAAGCCTGAGGCTGGTGAACAGTAGCTACAC ACCCATATTGTGTGTTCTGTGAATGCTAGCTCTCTTGAATTTGGATATT | SEQ ID NO: 1564 |
| CALU | ADXCRAD_CX788634_s_at | ATGTCATTGAAAGTGCCTTTAACGAAAGAAATGGTCACTGAATGGGAATTCTCTTAAGAAAC CCTGAGATTAAAAAAAGACTATTTGGATAACTTATAGGAAAGCCTAGAACCTCCCAGTAGAG TGGGGATTTTTTCTTCTTCCCTTTCTCTTTTGGACAATAGTTAAATTAGCAGTATTAGTTA TGAGTTTGGTTGCAGTGTTCTTATCTTGTGGGCTGATTTCCAAAACCACATGCTGCTGAATT TACCAGGGATCCTCATACCTCACAATGCAAACCACTTACTACCAG | SEQ ID NO: 1218 |
| CALU | ADXCRPD.558.C1_at | GTAAACCAAGTTTTATATTCTGCAATGCGAACAGGTACCTATCTGTTTCTAAATA | SEQ ID NO: 1563 |
| CAPN2 | ADXCRAD_AK023851_s_at | AGAATGGCAGTTGTCAGTCCTGTCCGTGTAACAGAGGAGTGAAGTGGTGAGGAGGGCAGGTC TAAGGCACTGGCAGCTCTTTTCCATGGATTTTGAACTCTGGAGGAAGGCAGCAACTAAATAA CTGTCTCATTCTGCTATTATGCATTGTATTAGCAAAGTGAAAATATAGTCTATCTGGTTACA AATAACACTAACTTGCTTAAAACTTTACATATCCTAGGAAATATCTCTACCCCTAGATTGCA ATGTAGAGTCAACCCCATCT | SEQ ID NO: 2826 |
| CAPN2 | ADXCRIH.1382.C1_at | GTATCTGGACCTCAAAATTATGGGAACATTTACTTAAACGGATGATCATAGCTGAAAATAAT GATACTGTCAATTTGAGATAGCAGACGTTTCACACATCAAGTAAAAGATTTGCATATCATTA TACTAAATGCAAATGAGTCGCTTAACCCTTGACCAGGTCAAAGAAAAGCTTT | SEQ ID NO: 2233 |
| CAPN2 | ADXCRIH.1382.C2_s_at | TGGCTCTGTTTCTCAGTACTTTGAAGTTATAACTAATCTGCCTGAAGACTTCTCATGATGGA AAATCAGCCAAGGACTAAGCTTCCATAGAAATACACTTTGT | SEQ ID NO: 2234 |
| CAPN2 | ADXCRPD.2526.C1_at | GGCACGAGAATGTACTCTCCTGGCGGCAGCTTGAAGCGGTTGAGCACCTCCCGGAGGTTGAT GAAGGTGTCTGAGCGCTCCCTGGCGCGATTCGTCAGGAAGAAGTTTTTGCTGAGGTGGATGT TGGTCTGCCCACTTAACTCCTCTGGAACCTCATAGATGCCAAAGCCGATGGTGTGCATGTCC TCGCCCATCTTCCTCTGCCGCCGTCGGTGCTTCTGAATGAG | SEQ ID NO: 1521 |
| CAPN2 | ADXCRPD.6630.C1_s_at | TGCGCTTGATCAACTGAACCAGTATGCCAAAACCAGGCATCCAATTTGTAAACCAATTATGA TAAAGGACAAAATAAGCTGTTTGCCACCTCAAAACTTTATGAACTTCACCACCACTAGTGTC TGTCCATGGAGTTAGAGGGACATCACTTAGAAGTTCTTATAGAAAGGACACAAGTTTGTTT CCTGGCTTTACCTTGGGAAAATGCTAGCAACATTATAGAAATTTTGCCTTGTTGCCTTATCT TCTTCCAAATGTACTGTTAA | SEQ ID NO: 1900 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| CAPN2 | ADXCRPD.9976.C1_at | TCGGCTCCGGTGACCGAGTACGCGTGCCCCTTCACCCAGCTTCTGAAACGTGAATGGCCTCCG AGTCCCCGGCGCTGGTGATGTCGATGGAGCAGCCAAGGAGAGAGCCTTTTTGCAGAGCTTTC TGGATGATCTTGAACAGGTTGGGAGGGGGCTTCTTCAACTCATACCACTCAGCAATGCTCCG GTGAAGTCTTCGAAGCCCTCAGTGGTGGCACCCCCTGATAGTGCTTCATAGCATCCGTTGAT CTTGCGTATGCCTTC | SEQ ID NO: 1552 |
| CAPN2 | ADXCRPDRC.9976.C1_at | ACGCGTACTCGGTCACCGGAGCCGAGGAGGTTGAAAGTAACGGAAGCCTACAGAAACTGATC CGCATCCGAAATCCCTGGGGAGAAGTGGAGTGGACAGGGCGGTGGAATGACAACTGCCCAAG CTGGAACACTATAGACCCAGAGGAGAGGGAAAGGCTGACCAGACGGCATGAAGATGGAGAAT TCTGGATGTCTTTCAGTGACTTCCTGAGGCACTATTCCCGCCTGGAGATCTGTAACCTGCCG AAGACCCAGCTTGAG | SEQ ID NO: 1965 |
| CAPN2 | ADXCRSS.Hs#S2984172_at | GAGCCACCACGGGTAGCAAAGTGAACTTCCCCCGAATCACGGTTAAGCCCCCTGGGCCACAT GGAGCTGTCATCTGCAGTTTTTCCCACCTCGGAGGCCTGACCCTGTGCTCTCCATAATCAAT GAGTAGATGTGGCCCTTTATGTTCCCTGAGGCTTCCCTGACTGCTCATTAAAAGGATCTGCT CAGTCCTAGTGAATTGATTTACTTTGCCACAGTCCTTGAAGGATGCTACAGATCAAAAGGTG TCCAGGAAAGTGATCTTAAAGATGCTGACACTACTCCCAGTT | SEQ ID NO: 2154 |
| CAV1 | ADXCRIH.1095.C2_at | TTTATTCCTCCTGCTCATATTGTGATTCTGCCTTTGGGGACTTTTCTTAAACCTTCAGTTAT GANNNNNNNNNNCATACACTTATTGGAACTCTGCTTGATTTTTGCCTCTTCCAGTCTTCCTGA CACTTTAATTACCAACCTGTTACCTACTTTGACTTTTTGCATTTAAAACAGACACTGGCATG GATATAGTTTTACTTTTAAACTGTGTACATAACTGAAAATGTGCTATACTGCATACTTTTTA A | SEQ ID NO: 1272 |
| CAV1 | ADXCRPD.1261.C1_s_at | TCAAGTTCCAAGTTGCTAATACAGCAACAATTTATGAATTGAATTATCTTGGTTGAAAATAA AAAGATCACTTTCTCAGTTTTCATAAGTATTATGTCTCTTCTGAGCTATTTCATCTANNNNN NNNNNNNNNNNNNNNNNNNNNNNNNNNNNNNNNNNNNNNNNNNNNNNNNNTTTGCATGTGGA TCAACCATCGCTTTATT | SEQ ID NO: 1881 |
| CCND1 | ADXCRAD_BM551840_x_at | TGAGGGACGCTTTGTCTGTCGTGATGGGGCAAGGGCACAAGTCCTGGATGTTGTGTGTATCG AGAGGCCAAAGGCTGGTGGCAAGTGCACGGNGCACAGCGGAGTCTGTCCTGTGACGCGCAAG TCTGAGGGTCTGGGCGGCGGGCGGCTGGGTCTGTGCATTTCTGGTTGCACCGCGCGCTTCC CAGCACCAACATGTAACCGGCATG | SEQ ID NO: 1593 |
| CCND1 | ADXCRAD_BQ436873_at | AAAAATAGTATTTGCATAACCCTGAACGGTGGGGAAGAGGGGTGTGCTACANATGATAGAG GGATTTTATACCCCAATTATCAACTCCGTTTTTATATTAATG | SEQ ID NO: 2640 |
| CCND1 | ADXCRPD.13939.C1_at | TTCACATTGTTTGCTGCTATGTGGAGGATCAGTGTTTTGTGTTACAATGTCATATACTGCCA TGTACTAGTTTTAGTTTTCTCTTAGAACATTGTATTACAGATGCCNNNNNNNNNNNNNNNNNN NNNNNNNNATGTGATCAATTTTGACTTAATGTGATTACTGCTCTATTCCAAAAAGGTTGCTGT TTCACAATACCTCATGCTTC | SEQ ID NO: 1727 |
| CCND1 | ADXCRPD.15960.C1_at | TGCCCGACAAACCTCCACTGGATGGTTTGTCACTGGATGGTTTGTTGGGGTGGTGGTCACAG GCGCAAAGGACATGCACACGGCCACGCTACGCTACTGTAACCAAG | SEQ ID NO: 1817 |
| CCND1 | ADXCRPD.16054.C1_at | ACCAAGTAGCTGTGGGTTGAACCTGGACGTGAGCTGGTTGCAGGGCCGTTGGGTAGAAAACC AGCATCTCATAAACAGGTCACTACAAAAATAGGAAGAGTATAAAAATAGAATATATTATGTC ACTATTTCGTCTTCTCTTTATAGTAGCGTATCGTAGGAGTGGGACAAGGTGGCCTTTCCCGA CACTGCTACGCTGGTCTGTGCCCGACAAACCTCACCTGATGTTGTACCTGAGTACGTTACTA AATCCTCAAGACCTTACACACAGC | SEQ ID NO: 1752 |
| CCND1 | ADXCRPD.3501.C1_s_at | TCTGTCTGAACCACGCGGGGCCTTGAGGGACGCTTTGTCTGTCGTGATGGGGCAAGGGCAC AAGTCCTGGATGTTGTGTGTATCGAGAGGCCAAAGGCTGGTGGCAAGTGCACGGGGCACAGC GGAGTCTGTCCTGTGACGCGCAAGTCTGAGGGTCTGGGCGGCG | SEQ ID NO: 1592 |
| CCND1 | ADXCRPD.3980.C1_s_at | GGAGGTGGACCTGGCTTGCACACCCACCGACGTGCGGGACGTGGACATCTGAGGGCGCCAGG CAGGCGGGCGCCACCGCCACCCGCAGCGAGGGCGGAGCCGGCCCCAGGTGCTCCCCTGACAG TCCCTCCTCTCCGGAGCATTTTGATACCAGAAGGGAAAGCTTCATTCTCCTTGTTGTTGGTT GTTTTTTCCTTTGCTCTTTCCCCCTTCCATCTCTGACTTAAGCAAAAGA | SEQ ID NO: 1679 |
| CCND1 | ADXCRPDRC.16054.C1_at | GTAGTGACCTGTTTATGAGATGCTGGTTTTCTACCCAACGGCCCTGCAACCAGCTCACGTCC AGGTTCAACCCACAGCTACTTGGTTTGTGTTCTTCTTCATATTCTAAAACCATTCCATTTCC AAGCACTTTCAGTCAATAGGTGTAGGAAATAGCGCTGTTTTTGTTGTGTGCAGGGAGGG CAGTTTTCTAATGGAATGGTTTGGGAATATCCATGTACTTGTTTGCAAGCAGGACTTTGAGG CAAGTG | SEQ ID NO: 2013 |
| CD44 | ADXCRAD_BM840380_s_at | GAGATCACTTCCAGCCTAATGTGCATTTGGCTGGAATATGGTTGTCTCAGAATAACATCATG CACTCGGGCTTTATACTTCTGCCTTTAGGGGACTGTGGCAGCATGGCATGGGTCAAGAAGT ACTTCTCCTTCATCTTCCTTTGATGTCGGTAACTCATCCTTTCTGCACTGCGGGAGTTGTTA ATGCTTTTGTGTCCTCCAGTTCACATGCTGATTGCTAAGAAGAAATGAGCATGAGTGAACC CAAAGCTGCTGAAACATTCTGCGTTTATGCAACTTCCTTG | SEQ ID NO: 2459 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| CD44 | ADXCRAD_BP233968_at | TGAATGGGTCCATTTTGCCCTTCCATAGCCTAATCCCTGGGCATTGCTTTCCACTGAGGTTG GGGGTTGGGGTGTACTAGTTACACATCTTCAACAGACCCCCTCTAGAAATTTTTCAGATGCT TCTGGGAGACACCCAAAGGGTGAAGCTATTTATCTGTAGTAAACTATTTATCTGTGTTTTTG AAATATTAAACCCTGGATCAGTCCTTTGATCAGTATAAT | SEQ ID NO: 2428 |
| CD44 | ADXCRAD_CN347079_s_at | TCAACAGTCGAAGAAGGTGTGGGCAGAAGAAAAAGCTAGTGATCAACAGTGGCAATGGAGCT GTGGAGGACAGAAAGCCAAGTGGACTCAACGGAGAGGCCAGCAAGTCTCAGGAAATGGTGCA TTTGGTGAACAAGGAGTCGTCAGAAACTCCAGACCAGTTTATGACAGCTGATGAGACAAGGA ACCTGCAGA | SEQ ID NO: 1104 |
| CD44 | ADXCRAD_CV026388_at | AATGCCTTTGATGGACCAATTACCATAACTATTGTTAACCGTGATGGCACCCGCTATGTCCA GAAAGGAGAATACAGAACGAATCCTGAAGACATCT | SEQ ID NO: 2327 |
| CD44 | ADXCRAD_CV026388_x_at | GTATGACACATATTGCTTCAATGCTTCAGCTCCACCTGAAGAAGATTGTACATCAGTCACAG ACCTGCCCAATGCCTTTGATGGACCAATTACCATAACTATTGTTAACCGTGATGGCACCCGC TATGTCCAGAAAGGAGAATACAGAACGAATCCTGAAGACATCTACCCCAGC | SEQ ID NO: 2328 |
| CD44 | ADXCRIH.1441.C1_at | CATCAAGAACAGACAAGGGTGTGTAGCGGTTTACAAATACAGCCATAAAAAAGTCAAACAGG ATCTACATGGCATCATCATTCCCCTTGGCCAATCCT | SEQ ID NO: 2235 |
| CD44 | ADXCRIH.1441.C1_s_at | AATCGGACACCCTGACTGATGAATAAATGCCACAAAGGACTTGCCAAGTGGGAGAAAATATG AGGTTAGAGGATAAAGCCAGTACTCTCTTGTTTGGTCATAAACTTGCCTATCTGGTGATAAG ATTCCAATGATGGGAATCCCTTTAACCTTTTGAGGGACTCCCCAGGCACTTAACTCATCCTA AATAGCAACTGCATCAAGAACAGACAAGGGTGTGTAGCGGTTTACAAATACAGCCATAAAAA AGTCAAACAGGATCTACATGGCATCA | SEQ ID NO: 2236 |
| CD44 | ADXCRIH.1441.C2_s_at | ATGGTCCATTCACCTTTATGTTATAGATATGTCTTTGTGTAAATCATTTGTTTTGAGTTTTC AAAGAATAGCCCATTGTTCATTCTTGTGCTGTACAATGACCACTGTTATTGTTACTTTGACT TTTCAGAGCACACCCTTCCTCTGGTTTTTGTATATTTATTGATGGATCAATAATAATGAGGA AAGCATGATATGTATATTGCTGAGTTGAAA | SEQ ID NO: 2237 |
| CD44 | ADXCRIHRC.1441.C1_s_at | GAAGAAGAAAAGCTCCTGACTAAATCAGGGCTGGGCTTAGACAGAGTTGATCTGTAGAATAT CTTTAAAGGAGAGATGTCAACTTTCTGCACTATTCCCAG | SEQ ID NO: 1379 |
| CD44 | ADXCRPD.11577.C1_s_at | AAACAGCATTGCTTTCTGAAATTAGGGCCCAATTAATAATCAGCAAGAATTTGATCGTTCCA GTTCCCACTTGGAGGCCTTTCATCCCTCGGGTGTGCTATGGATGGCTTCTAACAAAAACTAC ACATATGTATTCCTGATCGCCAACCTTT | SEQ ID NO: 1527 |
| CD44 | ADXCRSS.Hs#S1228681_at | TGCATTCCATTCCTTGTGTCTTAAAAGCAGACTGCAGTGTAGCTGAAGCAACCTTCTATTCA TGCCAAAGTGCTTTATTCTGTGACTATACCTTGTATTGAGCTCTAAAACCTCAGAGAGCTTT AAACTGGTTTTGCCTTTATAGAAAGGTTAAGTCCATTTGTGCATTACAGCTTTTATTCTGTG TGTGTGCATACTTAAATTAAAATGGAAATTTATTTGTTAGGTTAGTTTCTCCCAGAATTG CTCCTGGCAAAGAG | SEQ ID NO: 2068 |
| CD44 | ADXCRSS.Hs#S3898008_at | GTGAAACCAAAAGAACGCAGGCAAGAAACAGAACAGGAGGGGGAGGGCGACTAAAACATACA CTACCAGGGGAAGAAGAAAAAGTGGCCGCAGCCCCAGGAGGAAAATAAAGAAAAGGAACCCA CCACCTAGAAGACAGACATAATAAAAAGAACACGCCGAGCATGCACGCGTCAAAAACAAAA GAAGAAGGAGAAAACAAGCACCGCACGAGGTGAAGTCATTTGTGAAGGAAACGCACAACACA ATATGTGCGGGGAGGAAAAATAAGAGCGATACCACCCTCACG | SEQ ID NO: 2222 |
| CD59 | ADXCRAD_BP343697_s_at | TGCTAACTCCTAGCTGACTCAGCATAGATTGTATAAAATACCTTTGTAACGGCTCTTAGCAC ACTCACAGATGTTTGAGGCTTTCAGAAGCTCTTCTAAAAAATGATACACACCTTTCACAAGG GCAAACTTTTTCCTTTTCCCTGTGTATTCTAGTGAATGAATCTCAAGATTCAGTAGACCTAA TGACATTTGTATTTTATGATCTTGGCTGTATTTAATGGCATAGGCTGACTTTTGCAGATGGA GGAATTTCTTGATTAA | SEQ ID NO: 2355 |
| CD59 | ADXCRD_BP396775_s_at | CCTCGTGGGTTTATTATTACCTCATAGGGACTTTGCCTCCTGACAGCAGTTTATGGGTGTTC ATTGTGGCACTTGAGTTTTCTTGCATGCTTGTTAGAGAAACCAAGTTTGTCATCAACTTCTT ATTTAACCCCCTGGCTATACTTCATGGATTATGTTATAATTAAGCCATCCAGAGTAAATC TGTTTAGATTATCTTGGAGTAAGGGGGAAAAAATCTGTAATTTTTTCTCCTCAACTAG | SEQ ID NO: 1004 |
| CD59 | ADXCRAD_CN431378_s_at | GATAGCAGGGCATGAAAACTTAGAGAGGTACAAGTGGCTGAAAATCGAGTTTTTCCTCTGTC TTTAAATTTTATATGGGCTTTGTTATCTTCCACTGGAAAAGTGTAATAGCATACATC | SEQ ID NO: 2354 |
| CD59 | ADXCRAD_CX784253_s_at | GAGCTAACGTACTACTGCTGCAAGAAGGACCTGTGTAACTTTAACGAACAGCTTGAAAATGG TGGGACATCCTTATCAGAGAAAACAGTTCTTCTGCTGGTGACTCCATTTCTGGCAGCAGCCT GGAGCCTTCATCCCTAAGTCAACACCAGGAGAGCTTCTCCCAAACTCCCCGTTCCTGCGTAG TCCGCTTTCTCTTGCTGCCACATTCTAAAGGCTT | SEQ ID NO: 2353 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|------|----------------|----------------|-----------|
| CD59 | ADXCRPD.15392.C1_at | GGGCTATTGAGAGTCAGCACCAGCACTGATCATATATAGGATCAGCCTACTGGGGTTGGCCA CGTTGTATGTAGCTGCGAATAGCAAGGAGGGGAACAGCAACATCCCTAGGGAAACCGATCAC AGAAAGGCAGCTCACTACCCCACAGTAAAAAGAACCTTGAGTTTCCCAGTTCAGTCCCCTGC TGGGTGCATGCTACCCCCCTCCTCTCCCAGAGGCTCTGGACCTACACAGCTGCTGAAAAAGA GAAAATGTCCTTACCTACAATGAACCATCACAGGCACCCA | SEQ ID NO: 1745 |
| CD59 | ADXCRPD.18131.C1_s_at | GGCAAGCTCTTCACTATGACAGTAAAGGCTCTCTGCCTGCTGCCAAAGCCTGTGACTTTCTA ACCTGGCCTCACGCTGGGTAAGCTTAAGGTAGAGGTGCAGGATTAGCAAGCCCACCTGGCTA CCAGGCCGACAGCTACATCCTCCAACTGAACCTGATCAACGAAGAGGGATTCATGTGTCTGT CTCAGTTGGTTCCAAATGAAACCAGGGAGCAGG | SEQ ID NO: 1883 |
| CD59 | ADXCRPD.5301.C1_s_at | AACCCACTGGTGCAAGTCCTAGATTCCAAAGGCTGAAGAACCTGGAGTCTGATGTCCAAGAG CAGGAAGAGTGGAAGAAAGCCAGAAGACTCAGCAAACAAGGTAGACAGTGTCTACCACCACA GTGGCCATACCAAAGAGGCTACCGATTCCTTCCTGCTACCTGGATCCCTGAAGTTGCCCTGG TCTCTGCACCTTCTAAACCTAGTTCTTAAGAGCTTTCCATTACATGAGCTGTCTCAAAGCCC TCCAATAAA | SEQ ID NO: 1692 |
| CD59 | ADXCRPDRC.15392.C1_at | ATCTTTCCCCTTGCGGTACTAATCTATTGGCGCACAAGGAGGGCGTCACAGTGCT | SEQ ID NO: 2011 |
| CD59 | ADXCRPDRC.15392.C1_s_at | GTAGTGAGCTGCCTTTCTGTGATCGGTTTCCCTAGGGATGTTGCTGTTCCCCTCCTTGCTAT TCGCAGCTACATACAACGTGGCCAACCCCAGTAGGCTGATCCTATATATGATCAGTGCTGGT GCTGACTCTCAATAGCCCCAC | SEQ ID NO: 2012 |
| CDH11 | ADXCRAD_BG435621_at | ACAAACTAGTGGTGGGGGCACAGCAGAGCCCACGAAAAGAAGTTTTGT | SEQ ID NO: 2458 |
| CDH11 | ADXCRAD_CX866982_s_at | GGGTCCCTGAGCTCCCTAGAGTCGGCCACCACAGATTCAGACTTGGACTATGATTATCTACA GAACTGGGGACCTCGTTTTAAGAAACTAGCAGATTTGTATGGTTCCAAAGACACTTTTGATG ACGATTCTAACAATAACGATACAAATTTGGCCTTAAGAACTGTGTCTGGCGTTCTCAAGAAT CTAGAA | SEQ ID NO: 2709 |
| CDH11 | ADXCRAG_D21254_s_at | TTGTTACTGCTGATTCTTGTAAATCTTTTTGCTTCTACTTTCATCTTAAACTAATACGTGCC AGATATAACTGTCTTGTTTCAGTGAGAGACGCCCTATTTCTATGTC | SEQ ID NO: 986 |
| CENPF | ADXCRAD_AU132621_at | TCTTTCTCTTACAATCTGTTTTAGACATCTTTGCTTATGAAACCTGTACATATGTGTGTGTG GGTATGTGTTTATTTCCAGTGAGGGCTGCAGGCTTCCTAGAGGTGTGCTATACCATGCTCT GTCGTTGTGCTTTTTTCTGTTTTTAGACCAATTTTTTACAGTTCTTTGGTAAGCATTGTCGT ATCTGGTGATGGATTAACATATAGCCTTTGTTTTCTAATAAAATAGTCGCCTTCGTTTTCTG TAAGA | SEQ ID NO: 2490 |
| CENPF | ADXCRAG_AF118076_at | TATGCCATATATAATATCCCGAGGGATCTGCTATAATATTGCATAATCGAATTCATATTTC TGCAGCAAAATGTGTGGATACTCTCACAAGGCAGGATAAATAGAGACTATATATACTGGGCC AGGTG | SEQ ID NO: 859 |
| CENPF | ADXCRAG_AF118076_x_at | TGATGCCATATCAGATGGTTTTAGAATTCTGCACTTTAATAATGTAATGCATATGCCATATA TAATATCCCAGAGGGATCTGCTATAATATTGCATAATCGAATTCATATTTCTGCAGCAAAAT GTGTGGATACTCTCACAAGGCAGGATAAATAGAGACTATATATACTGGGCCAGGTG | SEQ ID NO: 860 |
| CENPF | ADXCRPD.1656.C1_s_at | GAAGGCACTTTGTGTGTCAGTACCCCTGGGAGGTGCCAGTCATTGAATAGATAAGGCTGTGC CTACAGGACTTCTCTTTAGTCAGGGCATGCTTTATTAGTGAGGAGAAAACAATTCCTTAGAA GTCTTAAATATATTGTACTCTTTAGATCTCCCATGTGTAGGTATTGAAA | SEQ ID NO: 1464 |
| CENPF | ADXCRPD.17056.C1_at | TCATCCTCTTGTGTGCCTGACAGCTCTAGTCTTAGCAGTTTGGGAGACTCCTCCTTTTACAG AGCTCTTTTAGAACAGACAGGGAGATATGTCTCTTTTGAGTAATTTAGAAGGGGCTGTTTCAG CAAACCAGTGCAGTGTAGATGAAGTATTTTGCAGCAGTCTGCAGGAGGAGAATCTGACCAGG AAAGAAATCCCTTCGGCCCCAGCGAAGGGTGTTGAAGAGCTTGAGTCCCTCTGTGAGGTGTA CCGGCAGTCCCTCGAGAAGCTAGAAGA | SEQ ID NO: 1788 |
| CNN3 | ADXCRIH.2427.C1_s_at | GCATTTGTGATTATATGTGTACTCATTCTCTTACCTAGCGAACAAGATCTTTTCAAAGTGGT GTTTCTAAAAGAGCATGTACAAAAGTGGCCTGTGGACATTTAGGCCTGGGTGATGCATTTGC TCTTCCTGTTTGTGCCAATGTATCAATGTAAAGTTGCTCTGTTTTCTTCAACTGTATTTATT GCTGCATTTCTCAGCATAAACTTATCCCATTGT | SEQ ID NO: 1157 |
| CNN3 | ADXCRPD.1098.C1_s_at | AAGAGCAAATGCATCACCCAGGCCTAAATGTCCACAGGCCACTTTTGTACATGCTCTTTTAG AAACACCACTCTGAAAAGATCTTGTTCGCTAGGTAAGAGAATGAGTACACATATAATCACAA ATGCACACTGATCATGACTTTATTTAAAATTAGCAAACAATACTGTAGAAACATTGATATG TAAATTTCTAAAATGCTGCATCTTAAATTTAGTTGGCAAAGACCACATTTAGCAATAAGCAT GAGTTTAGTCTTCCATGTAGAAAACCAGATA | SEQ ID NO: 1847 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| CNN3 | ADXCRPD.2332.C1_at | CATATCAAATGGTTTCTAACAGGTATTGGTTTGCCTAATTTTCAAAACAAACCTCCTTGATC CACGGGGGCCCTTTTGATGAATTACAATGGGGGAACCTCCATTTCCCCTTTACCCGACGGCG GAACACCACAATTCTTTTTTCCCCAAGCGGGGTTGCTCTCTCTTTACCAAGCAATCCTTTGG TTACCCAATCACCGTGTGCGCCTTGTGTGGTAACACTTTTTCAACGCGCCCTCATGCGGAGA CGAAATCGCACTCTCTTTGCG | SEQ ID NO: 1476 |
| CRIM1 | ADXCRAD_AI651806_s_at | ACATTTTCTTTTCACGTTAAGCATACTGGGTATCTGTGTCTTTCACAACAAGCATTTTTAAA AGAAAACTCAATGCACAAATGGGTTAATTAGTATAAAAGTGCTAAGGGCTGTTTGAAAAGTT ACCACTATAGTATACAGTCAGTTATATTTGAGGCATACTACAACAAACTTCCAGCTTATTGT GGACAATATTCCAGTAGTTGTTTCAAACCATTGTTTGAAAAAAAAAAAAAAAAAATCCAGGA GCTGATTAGTGATGCAG | SEQ ID NO: 2454 |
| CRIM1 | ADXCRAD_BC016339_s_at | AAGAATCTTCACTTGGGTGCAGCCTGTTATCTCTGTAATCTACCTGGAGGTGACCCATATCT AGGAGAAAAAAAATTATAAGCATTTATTACCTAAACCAGAATTGTTAAGGATTATTTTAATG ACATTGCAAATAGAGATCAGCAACTTGGTTTTATTGCTTCCCAGTTTTTTGAGGCTAAAAAT GTGATTAAAATCTAATGTTGATCCAAAGAGCTCTTAGTAGAGAGCAGAGCGCTTA | SEQ ID NO: 2786 |
| CRIM1 | ADXCRAD_BG621095_s_at | AAAAAATTGTAGATGCTTGCTTTTTGTTTTTTCAATCATGGCCATATTATGAAAATACTAAC AGGATATAGGACAAGGTGTAAATTTTTTTATATTTTAACAGATATGATTTATCCTGAG TGCTGTATCTATTACTCTTTTACTTTGGTTCCTGTTGTGCTCTTGTAAAAGAAAAATATAA ATTTCCTGAAGAATAAAATAGATATATGGCACTTGGAGTGCATCATAGTTCTACAGTTTGTT T | SEQ ID NO: 1128 |
| CRIM1 | ADXCRAD_C16716_s_at | CTTCTAGCCGTCAAACTCTGATCGACTTACACTTAAGACTGTGTCTTTGGTAGCCTACCCTA TTCCACTTTTATTACAAAGGCAGCTCTTAAGACATAAATCCATCTCTTCAGGCTCGAACTGC AAAACACACGTCGAGAGGTGACAATGTTGGGACTGTCAAAAAGAACTTAAAGAGTGGGATAA CCAGCCGGGC | SEQ ID NO: 2751 |
| CRIM1 | ADXCRAD_CD101810_at | AAATAGAATTGACCTCCAGCCCGGATTAGGCATAAATTTTG | SEQ ID NO: 2396 |
| CRIM1 | ADXCRAD_CD101810_x_at | GGTGTTCTACCTGTTTGCATCAAAGGAAAAAAAGATTTTTTTTCCAAGGGCCAATTTTTTTA TCTTTTCCCAAAAAAAATTTGTTAATGGAACATTTACAAAAATAGAATTGACCTCCAGCCCG GATTAGGCATAAATTTTGGTTGGGA | SEQ ID NO: 2397 |
| CRIM1 | ADXCRAD_AA642418_s_at | GACTTATACTCATGAGGTCTACCTACAGTCCATTCCCATTTAGGGGAAGAGAAAGGAGAGGA AATGGCCAAGAAGTCCATAAGAAGTGGACAGTGCTTTAACTTTTTCAAGTTTTGCTAACATA TTTTATGTAAGTTATTCAATACCCCCATATTAAAGAGCAGCAGCTATTAAACACCAACATTT ATTAGCTGCTGGAAAGTAATAAATAACTTCAGCTAGTCCCCTTCAGTTTCCATAAAATTATA AAACCAACCATTTGACGTGAAAAAGCAGTTT | SEQ ID NO: 2873 |
| CRIM1 | ADXCRAG_AC007401_at | GGGCAGAAAAGCCATGTCGCCATTTACTTGACACCTTTCAGTGCCACACACACCCTTCTGCC CCTCCCCTGCCTAGTCCAGGGCTTCACACTGAGCCTTCCTATGACAATAGGGGCCGAACTGC CACTGGTTTCTGAGGCCTCAGTGTAAAGGGCAAATGCGACACCAATTCCAACAAACCTGTAA ATGTCAATGGCTAAGTAGTAAAAGTTTCTGCAGAGGCCCCAGAGCTGGGATTGATTCAGTTC CACCTCAGGTTTTTTCCTGAGTGAGAGGGAGAGACGTAACTTTGGAAT | SEQ ID NO: 842 |
| CRIM1 | ADXCRAG_AF168681_x_at | ACTAATGATAATCCATCTCCCTTGCTGACTCTCTTTTCGGACTCAGCCCGCCTGCATCCAG GTGAAATAAACAGCCGTGTTGCTCACACAAAGCCTGTTTGGTGGTCTCTTCACACGGACGCA CATGAAATTTGGTGCCGTGACTCGGATCGGGGGACCTCCCTTGGGAGATCAATCCCCCTGTC CTCCTGCTCTTTGCTCCATGAGAAAGATCCACCTACGACCTCAGGTCCTCAGACCGACCAGC CCAAAAACAT | SEQ ID NO: 869 |
| CRIM1 | ADXCRPD.11873.C1_at | GTCCCTACTGCATAGAAGACACAATTCCAAAGAAGGTGGTGTGCCACTTCAGTGGGAAGGCC TATGCCGACGAGGAGCGGTGGGACCCTTGACAGCTGCACCCACTGCTACTGCCTGCAGGGCC AGACCCTCTGCTCGACCGTCAGCTGCCCCCCTCTGCCTGTGTTAGCCCATCAACGTGGAAGG AAGTTGCTGCCCATGCGTCCATGTAAGG | SEQ ID NO: 1583 |
| CRIM1 | ADXCRPD.11873.C1_s_at | TGCATTGATAGCGTAATTAGCTGTTTCTCTGAGTCCTGCCCTTCTGCATCCTGTGAAAGACC TGTCTTTGAAAAGGCCAGTGATGTCCCTACTGCATAGAAGACACAATTCCAAAGAAGGTGG TGTGCCACTTCAGTGGGAAGGCCTATGCCGACGAGGAGCGGTGGGACCCTTGACAGCTGCAC CCACTGCTACTGCCTGCAGGGCCAGACCCTCTGCTCGACCGTCAGCTGCCCCCCTCTGCCTG TGTTAGCCCATCAACGTGGAAGGAAGTTGCTGCCCA | SEQ ID NO: 1584 |
| CRIM1 | ADXCRPD.15616.C1_at | ACAGATGTCACAGCCGTGCTTATTCTTCAGCAATCCAAGTGGACAATACTTGTCACAGATTA TGGGTCTGCACTTCTTGGGCCTTGGGCGGCACTCACAGATCTCACAGTTTTGGGCATCAGTA AGGAAACCGAAGGGACAGTTCAAGGTGCAGCCTTGTTTACGTTCTGAACATAGTTCCTCGGT GTTTATGCACTCACAGGTCCGACAACCATTGTGATCGCGTTTGAAACCATTAATGCAGTCCT TCCCTGTCAGAGGCAGTTTGATACGGTCCCGAC | SEQ ID NO: 1774 |
| CRIM1 | ADXCRPDRC.15616.C1_s_at | AGTGCAGACCCATAATCTGTGACAAGTATTGTCCACTTGGATTGCTGAAGAATAAGCACGGC TGTGACATCTGTCGCTGTAAGAAATGTCCAGAGCTCTCATGCAGTAAGATCTGCCCCTTGGG TTTCCAGCAGGACAGTCACGGCTGTCTTATCTGCAAGTGCAGAGAGGCCTCTGCTTCAGCTG | SEQ ID NO: 2018 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| | | NGCCACCCATCCTGTCGGACACTTGTCTCACCGTGGATGGTCATCATCATAAAAATGAGGAG AGCTGGCACGATGNGTGCCGNGAATGCTACTGTCTCAATGGACGGG | |
| CRIM1 | ADXCRSS.Hs#S1805720_s_at | GAAGATGTTTGTCTGAGCATCCCATGAGGTAAGCAGCCCCATGGAAGGACCAGCTGCATCCA GCAAAGGGCTCCAGGTCCCTGACGTAGTTGACGGTGATGGCAGAAGTAAATCTTTGTATTCT TGCAGAGACTTTGTTTTTCTGTCATTCCACAGCAGCTCAGCATACTCTAATAAACGTCCTCC TCTTCCCCTTCGTAGCATTCTGGGACTAATCAGGGTTTCATCTGCTCACATATTGTAGCGAT GGGTTC | SEQ ID NO: 2065 |
| CTNNAL1 | ADXCRPD.129.C1_at | GACAGACACACTGGGAGTCGTGCTGCGCACCCCCCCTATTATTTTCGCGCACCCAATTTAAA GAGGTGGGCCGGCCGCGCCCACCCGTCCATCACCTCGATATGCACACTACCTCCGCCGTCGG GGCCCTCGCGGCCCGCCATGCTGTTCGCAAACACTCACCGCCCGGCCGCGGGTCCGCGATGC TGCGCGTGTGTGAGAAGTATGGTGAGCGCGATATGGCGGCAACACCACTGTCGACTTGTCTC G | SEQ ID NO: 1484 |
| CYR61 | ADXCRIH.1579_C1_at | TACCTAATATCTGAGTGTATGCCATTCGGTATTTTTAGAGGTGCTCCAAAGTCATTAGGAAC AACCTAGCTCACGTACTCAATTATTCAAACAGGACTTATTGGGATACAGCAGTGAATTAAGC TATTAAAATAAGATAATGATTGCTTTTATACCTTCAGTAGAGAAAAGTCTTTGCATATAAAG TAATGTTTAAAAAACATGTATTGAACACGACATTGTATGAAGCACAA | SEQ ID NO: 1207 |
| CYR61 | ADXCRPD.10589.C1_at | GGAACCGCATCTTCACAGTCCTGGTCAGCTGGGGCGTGCAGCATCGGCCGTCCACGCAGGAA CCGCAGTACTTGGGCCGGTATTTCTTCACACTCAAACATCCAGCGTAAGTAAACCTGACTGG GTTCGGGGGATATCTTGGTACTTGCTGCATTTCTTGCCCTTCTGTAAGAAGGCGAGAAG GCAAGTTAGGGGTGATATTTCTCTTTCTTCAAAAAGATGTTCACATCCCAACCACCTGCCAG GCAACAGTCTACACGTCCCTTAAGGAACTTACTTTCAGGCTGCTGT | SEQ ID NO: 1443 |
| DKK1 | ADXCRAG_AF177394_s_at | GTTATCTTGACTGACAAATATTCTATATTGAACTGAAGTAAATCATTTCAGCTTATAGTTCT TAAAAGCATAAACCCTTTACCCCATTTAATTCTAGAGTCTAGAACGCAAGGATCTCTTGGAAT GACAAATGATAGGTACCTAAAATGTAACATGAAAATACTAGCTTATTTTCTGAAATGTACTA TCTTAATGCTTAAATTATATTTCCCTTTAGGCTGTGATAGTTTTTG | SEQ ID NO: 870 |
| DNAJB6 | ADXCRAD_BQ222360_at | GGAAAAGGAGTGGTATTTGAATGCTTTCTGTGGGACAATGTACCCCCTAAACACATCATGTA TTTTTAAATTGCCACCCTACCTAAAATAAAACCATAAGCCATATTTGAAA | SEQ ID NO: 2717 |
| DNAJB6 | ADXCRAD_BQ222360_s_at | AAAATGCCAGCAATTTTAATCTAGCAGTGTTGAAGCTGGGAATTTTTTGGCGCAATCCATGT AGCAGTGACCCAGGCTTGGGAGCCAGAAACAAGTGTGACCT | SEQ ID NO: 2718 |
| DNAJB6 | ADXCRIH.476.C2_at | TTGTGTCTGAAATGTGAGCCACGTAGTGTCGGCCTGCTGTGAAGTTAACATTGCCAGGACGA TTCTTCTACAGAAATAATTTCAATTTTTTTCAGTATTTAGTAGTGAAAGATATTAATACATT AATGGTAATACATTTCTGGTTTAATATAAATTAAGGATGTTTCTAGTTGTGCATGAATGCT GGCAACTTAGTAAGTTTTGACAATTGTTTAAATATGTAATGTTAAGCTTAGGTTTAAAAAAG TAAAGCTGGTAAACTGGGTCTTTGTCATTTG | SEQ ID NO: 1281 |
| DNAJB6 | ADXCRPD.14111.C1_at | GAGTGTGGCCTCGAGACAGTCCTGACCGACGCTGCTACCTAGCGCGTGTGCACGACCGCATG CCGAGCACGGTGGAGCGCCAGCGTCTGGGGGTGCACCGCGTGCCTCAAGTCCGGTCTAGTGA TTGCCTTTGGTCGANNNNNNNNNNNNNNNNNNNNNNNNNNNNNNNNNNNNNNNNNNNNNNN NNNNNNTTTCAATCCTGCTGCGGACGCGAGG | SEQ ID NO: 1657 |
| DNAJB6 | ADXCRPDRC.14111.C1_at | TGAGTAACATTCATGCAATGAGCACTCAGTGG | SEQ ID NO: 1986 |
| DNAJB6 | ADXCRPDRC.14111.C1_s_at | AGGACTGTCTCGAGGCCACACTCGCTCGGCAGGATTATTCGATCACGGATCAGTCAGAGCAG GGTCAGGAGACGGGGCTGACGGCACGGGTGGCGGGACAGACGTTTGGGACTTGGCCGCGAC TCTCTGCTTCTCTCCAGCTCTCAATCTGCTGCATTTTCCTCTAGTGCTTCCGGATCCTCTTC ATTCTTTTCGGCATACTCAACCACTCCGCATGCTGCTGGAATATTTCTGGCTTTAGAAGTAC AGGAGGCGCAGATGGCTAACTGAGTAACATTCATG | SEQ ID NO: 1987 |
| DNAJB6 | ADXCRSS.Hs#S1921365_at | GAAACAGTCTCGTACATCACGGTTCATTTTTAACCTTTTTCTTAAATTTTAGAGATGGCAT CTCATTATTTTCCCCAAGCTGGACTCGAACTCCTGGGCTCAAGGAATCTCCTACCTCAGCC TCCCCAGTAGCTGGCATTACAGGGGTACACCACCATGCCTGGCTTAGTATGTGATGTTTTA TGTGTATTTAAAAAAGACTCCTTAACTTCTTCTAAGTGACCTGTGTGTAGGTGTGCCTGTGT ATGAACTCTGTCCAA | SEQ ID NO: 2100 |
| DNAJB6 | RDCR166_G12_at | TCTGGGGTGTTTTGCGCGTGTGTAAATACCGGCCCGTTTTTCTCCAGCATGGCCCCTAATCC ATGGGACACTAGGGAGGGGTGCCCTGAGCAAAAATTTTTTGGCTAAAATAATTAGCTAAATC CCATGTAAAAATTAT | SEQ ID NO: 1360 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| DNAJB6 | RDCR166_G12_s_at | TGGGCGCATCTAGTTAGAATGAAGTGACTTTCGTAAGGAGTCAATGTTCGCGAACTGAAACA TGAGTTCAACCTCCTTGTGCCGGCCTCTGGGGTGTTTTGCGCGTGTGTAAATACCGGCCCGT TTTTCTCCAGCATGGCCCCTAATCCATGGGACACTAGGGAGGGGTGCCCTGAGCAAAAATTT TTTGGCTAAAATAATTAGCTAAATCCCATGTAAAAATTATGGAATCTAGCAAAACCTACACC ATATTT | SEQ ID NO: 1361 |
| EMP3 | ADXCRPD.3976.C1_s_at | TTGCACCAGCGTGGCGGTGTTTACTGGCGCCTTGATCTATGCCATTCACGCCGAGGAGATCC TGGAGAAGCACCCGCGAGGGGGCAGCTTCGGATACTGCTTCGCCCTGGCCTGGGTGGCCTTC CCCCTCGCCCTGGTCAGCGGCATCATCTACATCCACCTACGGAAGCGGGAGTGAGC | SEQ ID NO: 1915 |
| F3 | ADXCRAD_BU941055_at | GGAATTGTTACTGGTGTACTTATTCTATCTTCCATTTTATTATTTATGTACAATTTTGGTGT TTGTATTA | SEQ ID NO: 2425 |
| F3 | ADXCRAD_BU941055_x_at | GGAATTGTTACTGGTGTACTTATTCTATCTTCCATTTTATTATTTATGTACAATTTTGGTGT TTGTATTAGCTC | SEQ ID NO: 2426 |
| FAM50A | ADXCRPD.13832.C1_s_at | AATCCAACATTGACAAGAAGTTCTCTGCGCACTACGACGCGGTGGAGGCAGAGCTCAAGTCC AGCACCGTGGGTCTCGTGACCCTGAATGA | SEQ ID NO: 1708 |
| FAM50A | ADXCRPD.6370.C1_at | TGGGACAAGTACACGATCCGCTGAGCATCCAGGAGGCTGCGCGGCCCCGGCTCCTCAGCTCC CTCAGTGTGCCCCGTGGTGTCACCGGGACTCCAGGCACCCGCTCCCCTGCGACCATGCCAGG CACGCTGGGAGGAGGACGGCAGCTGCTCGTGTCCTGCCCCTGCCACATCAGTGACTGCTTTA TTCTTTTCCAATAAAGAAGTGCACGTGTCAGAGCTGGAGCGCCTGCATTGTGAGAAACCAA | SEQ ID NO: 1743 |
| FAM50A | ADXCRPD.6370.C1_x_at | GACAAGTACACGATCCGCTGAGCATCCAGGAGGCTGCGCGGCCCCGGCTCCTCAGCTCCCTC AGTGTGCCCCGTGGTGTCACCGGGACTCCAGGCACCCGCTCCCCTGCGACCATGCCAGGCAC GCTGGGAGGAGGACGGCAGCTGCTCGTGTCCTGCCCCTGCCACATCAGTGACTGCTTTATTC TTTTCCAATAAAGAAGTGCACGTGTCAGAGCTGGAGCGCCTGCATTGTGAGAAACCAA | SEQ ID NO: 1744 |
| FAM50A | ADXCRPDRC.6370.C1_at | ACTGCTGCATGGTGTTGCCCTTTCTCATCTTGACTGTCCGCCGGTGCCCAGAGCCATCCCAG TAGCTGAAGGTGATCTCGATCTCCTCACTCTTGATCTTCTCCTGCTTGGCTTCCCACTCCTG CCGCAGCTCTTCCCGAAGCCGATTCTCCTCCTCCTCACGGTCTCGATCAGGCAAGAAGCTTG TGTCAACGTCTGGGT | SEQ ID NO: 2010 |
| FHL1 | ADXCRAD_BP325154_s_at | GTGATTCCTAGGACTTTTCCTCAAGAGGAAATCTGGATTTCCACCTACCGCTTACCTGAAAT GCAGGATCACCTACTTACTGTATTCTACATTATTATATGACATAGTATAATGAGACAATATC AAAAGTAAACATGTAATGACAATACATACTAACATTCTTGTAGGAGTGGTTAGAGAAGCTGA TGCCTCATTTCTACATTCTGTCATTAGCTATTATCATCTAACGTTTCAGTGTATCCTTACAG AAATAAAGCAGCA | SEQ ID NO: 1850 |
| FHL1 | ADXCRAD_BP361024_at | GACTGTGTCAAGAGTGAGCCACCCAGTCTCTAAAGCTAGGAAGCCCCCAGTGTGCCACGGGA AACGCTTGCCTCTCACCCTGTTTCCCAGCGCCAACCTCCGGGGCAGGCATCCGGGTGGAGAG AGGACTTGTCCCTCGTGGGTGGTGGTTCTTTATAGAA | SEQ ID NO: 2502 |
| FHL1 | ADXCRAD_CX872156_s_at | CACTTACCAGGATCAGCCCTGGCATGCCGATTGCTTTGTGTGTGTTACCTGCTCTAAGAAGC TGGCTGGGCAGCGTTTCACCGCTGTGGAGGACCAGTATTACTGCGTGGATTGCTACAAGAAC TTTGTGGCCAAGAAGTGTGCTGGATGCAAGAACCCCATCACTGGG | SEQ ID NO: 2369 |
| FHL1 | ADXCRPD.10038.C1_at | TGCAGAAGAGTCAATCTACCTAAGTTTTCATTTTTAAATTGCAGCCGGACAGAAATTCACTT TGCTGCAGGGTTGCTTTTTGCTAAATGCTAATATGATCACTGTGTGCCCTTATTTGAGTAAT ACTGTAAAATGGGAGAAAAGACGGAAGGAGAACTTTAAAGAAGGGAAGGACCACTCTTCCCC TATTGATGGTATAGGGCAGAAAGTAAGGACACAAAGAACGAGATTCAAATGCCATTTTACAG GACAGGAGCCCCTGTCAGTTTACAGCTTGAGACACGCGACGGGTACCGAG | SEQ ID NO: 1838 |
| FHL1 | ADXCRPD.11024.C1_s_at | TGTGCTTTCAAATAACTAACACGAACTTCCAGAAAATTAACATTTGAACTTAGCTGTAATTC TAAACTGACCTTTCCCCGTACTAACGTTTGGTTTCCCCGTGTGGCATGTTTTCTGAGCGTTC CTACTTTAAAGCATGGAACATGCAGGTGATTTGGGAAGTGTAGAAAGACCTGAGAAAACGAG CCTGTTTCAGAGGAACATCGTCACAACGAATACTTCTGGAAG | SEQ ID NO: 1409 |
| FHL1 | ADXCRPD.16965.C1_at | GGGCCCTATGAACAGACCATTCCTGGGGACCGAATACCTTGCTTTCCACCTGCAAAAAAAGT CTCCCTGGGAAATCCTGGCCCAACAAAGAGCTTTGTTNTTTCCCCCAGCGAACAAAGGGT ATTTGTCCCTGAATGTGTGCCAAAAAACACGTGTAAACACTAACAAGGAGGCTCTCTTGGAC CTTCGAAAAAGGGCAATTGGAAATCTCCGGCCCCTTTTGAGGCCCTTGACTTTCATGGCCC TCATCCCCAGTCGATAAGGG | SEQ ID NO: 1388 |
| FHL1 | ADXCRPDRC.10038.C1_at | AGTATTACTCAAATAAGGGCACACAGTGATCATATTAGCATTTAGCAAAAGCAACCCTGCA GCAAAGTGAATTTCTGTCCGGCTGCAATTTAAAAATGAAAACTTAGGTAGATTGACTCTTCT GCATGTTTCTCATAGAGCAGAAAGTGCTAATCATTTAGCCCACTTAGTGATGTAAGCAAGAA GCATAGGAGATAAAACCCCCACTGAGATGCCTCTCATGCCTCAGCTGGGACCCAGCTTGAGA CCCGCGA | SEQ ID NO: 2035 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| FHL1 | ADXCRSS.Hs#S3747393_at | TGCAGCTCCCTTTGCCAAGGCATTTCCTATAGAATCCTGCCACCCAAAAGGTACCAAATATG AGTTTCTATTAGCTTTCAACTTCTTTAAACATATGCTAATTTGTTCCTCTCCCCCGAAAAAG AGATTTGCACGGGTAAATAGATAGCAATTATTTCATTTGTGCAGGAAATACAAGAATTGAGA CTACTTTCTAAAACTATCCACAAACATGGTTATTGTGCTAGCAAACTTCCAGCGTAATTTAG AGAGAAAGAATGAGAGAAATAAATGAGCAGTTGCCTGGTACTCAC | SEQ ID NO: 2193 |
| FHL2 | ADXCRIH.1926.C1_at | TTGTGATAGTTCAGTCCCAGGGAAAGAGAAAACTCGCCCTAGGCCCTAGGTGGGAAGATGGT TTGAAATTTTTGTAATCGAGTAAGGCACACCCAAATGTAAAAATCCTTTTGAATGATGCCTT TATAAATCTTTCTCTCACTGTCTATTTAAGTGCAATTAACATATGTCACGAACTTGAAAGTT TTCTAAACTCAATAAGGTAATGACCAGTTGTTATTTACAGCTCTGTAACCTCCCGTTGCGTC AAGTCTAAACCAAGATTATGTGAC | SEQ ID NO: 2240 |
| FHL2 | ADXCRIH.1926.C1_s_at | CGCCCTAGGCCCTAGGTGGGAAGATGGTTTGAAATTTTTGTAATCGAGTAAGGCACACCCAA ATGTAAAAATCCTTTTGAATGATGCCTTTATAAATCTTTCTCTCACTGTCTATTTAAGTGCA ATTAACATATGTCACGAACTTGAAAGTTTTCTAAACTCAATAAGGTAATGACCAGTTGTTAT TTACAGCTCTGTAACCTCCCGTTGCGTCAAGTCTAAACCAAGATTATGTGACTTGCAATAAA GTTATTCAGA | SEQ ID NO: 2241 |
| FHL2 | ADXCRIH.1926.C2_at | CGCTTCACAGCTCGCGATGACTTTGCCTACTGCCTGAACTGCTTCTGTGACTTGTATGCCAA GAAGTGTGCTGGGTGCACCAACCCCATCAGCGGACTTGGTGGCACAAAATACATCTCCTTTG AGGAACGGCAGTGGGCATAACGACTGCTTTAACTGTAAGAAGTGCTCCCTCTCACTGGTGGG GCGTGGCTTCCTCACAGAGAGGGACGACATCCTTGTGCCCCGACTGTGGGAAAGACATCTGA ATCAACACAGAGAAGTTGCTGCTTGTGATCTCCCACACGAATTTTTATGTT | SEQ ID NO: 2242 |
| FHL2 | ADXCRIH.1926.C2_s_at | TCAGCGGACTTGGTGGCACAAAATACATCTCCTTTGAGGAACGGCAGTGGGCATAACGACTG CTTTAACTGTAAGAAGTGCTCCCTCTCACTGGTGGGGCGTGGCTTCCTCACAGAGAGGGACG ACATCCTTGTGCCCCGACTGTGGGAAAGACATCTGAA | SEQ ID NO: 2243 |
| FKBP9 | ADXCRAD_CD251162_s_at | GCAGAGGCCAGCTGCCGCAAGACAGCAATGACAGTCCACCTGCCGACCTGATTCCTGCATCA TGGAATAACCACATGGCTACCTTCTATCCTCTGTTCCCAAATGGTGGTGGCACTTATCCTGA AGTCGTCAATGATTTCCCTTTGAAACTACTTTATTTTACTAATTTAAACTATTTTGTACTGA TGTAGCCCTGAGGTAGTTCATGAAAATGCTGTGCACTCATTCCATGGAATAAATGTTGGAAA GCTGATCTTTTCTGATATAA | SEQ ID NO: 923 |
| FKBP9 | ADXCRPD.16135.C1_at | GGGCCATCATCAGAATTTGCACAGGCTGCTGGGAAGAGCCATGGCTGTCTGCTGGGAACTCT GCTGGGGCAAGCAAGCCCTTTGACTCTCCTGCCCATCTCAAGAATATTT | SEQ ID NO: 1762 |
| FKBP9 | ADXCRPD.16135.C1_x_at | GGGCCATCATCAGAATTTGCACAGGCTGCTGGGAAGAGCCATGGCTGTCTGCTGGGAACTCT GCTGGGGCAAGCAAGCCCTTTGACTCTCCTGCCCATCTCAAGAATATTTCTAA | SEQ ID NO: 1763 |
| FKBP9 | ADXCRPD.3075.C1_s_at | AGAAGTTTGGGCTGATCGCCAGTGATAGTAAACAAAATCTGTGCAGAGGGCCTTAGCATGGG ATGTGTCCAGTATTGAAAAGGCTGCACTGCCAACCATGATTTGTGAGCCTTCTGGGAAATTT TGTTATTAAAGGAATATATAGTGTCAGACGGAAGTTATAATCATCTTGGAGGAACCATAAGA AAAGGTGTCCAGGGTATCTATATAAA | SEQ ID NO: 1918 |
| FLNA | ADXCRAD_CN332899_at | TGACCTCTCGGCTTTCACTTGGGCAGAGGGAGCCATTTGGTGGCGCTGCTTGTCTTCTTTGG TTCTGGGAGGGGTGAAGGATGGGGGTCCTGTACACAACCACCCA | SEQ ID NO: 2347 |
| FLNA | ADXCRAD_CN332899_x_at | TGACCTCTCGGCTTTCACTTGGGCAGAGGGAGCCATTTGGTGGCGCTGCTTGTCTTCTTTGG TTCTGGGAGGGGTGAAGGATGGGGGTCCTGTACACAACCAC | SEQ ID NO: 2348 |
| FLNA | ADXCRPD.10169.C1_at | TCAGGCAACCTGACGGAGACCTACGTTCAGGACCGTGGCGATGGCATGTACAAAGTGGAGTA CACGCCTTACGAGGAGGGACTGCACTCCGTGGACGTGACCTATGACGGCAGTCCCGTGCCCA GCAGCCCCTTCCAGGTGCCCGTGACCGAGGGCTGCGACCCCTCCCGGGTGCGTGTCCACGGG CCAGGCATCCAAAGTGGCACCACCAAC | SEQ ID NO: 1867 |
| FLNA | ADXCRPD.13338.C1_at | GGTAGGCGTCAATGTCACTTACTGGAGGGGATCCCAGCCCTAAGAGCCCTTTCTCAGTGGCA GTATCTCCAAGCCTGGACCTCAGCAAGATCAAGGTGTCTGGCCTGGGAGAGAAGGTGGACGT TGGCAAAGACCAGGAGTTCACAGTCACAATCAAAGGGTGCTGGTGGTACAAGGCAAAGTGGC ATCCAAGTATTGTGGGCCCCTCGGGTGCAGCGGTGCCCTGCAAGGTGGAGCCAGGCCTGGGG GCTGACAACAGTGTGGTGCGCTTCCTGCCCCGTGAGGAAGGGCCCTATGA | SEQ ID NO: 1621 |
| FLNA | ADXCRPD.15612.C1_at | GCTACACCATTATGGTCCTCTTTGCTGACCAGGCCACGCCCACCAGCCCCATCCGAGTCAAG GTGGAGCCCTCTCATGACGCCAGTAAGGTGAAGGCCGAGGGCCACTGGCACTCAGTCGCACT GGTGTCCAGCTTGGCAAGCCCACCCACTTCACAGTAAATGCCAAAGCTGCTGGCAAAGGCAA GCTGGACGTCCAGTTCTCAGGACTCACCAAGGGGGATGCAGTGCGAGATGTGGACATCATCG ACCACCATGACAACACCTACACAGTCAAGTACACGCCCTGTCCAGT | SEQ ID NO: 1773 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| FLNA | ADXCRPD.16964.C1_at | TGGGCTGTCACTTTTGCTGGCGTCACCCTGTGACTTATCCACGTACACCTCGAAGGGGCTCT TGGCGATGTGCTGGCCAGCAAAGAGCACAGTAACCTTATGAGTCCCCGTCAACTCGGGGACG TACCAGACGGAGAAGGTGCGGTTCTTGTCGTTATTGGCGGTCACTTTTGCCTCCTCCTGGTG TCCGGCCGGGTCCTCCACGTACACCAGCACCTCTCCCTGGCCAGCACCTCTGGTCTCCACAG TGAACTCTACCCGCTTCTTCACAATGCACGTGATCAAATCCTGTAGAGTC | SEQ ID NO: 1387 |
| FLNA | ADXCRPD.3034.C1_at | AGTACAATGAACAGCACGTCCCAGGCAGCCCCTTCACTGCTCGGGTCACAGGTGACGACTCC ATGCGTATGTCCCACCTAAAGGTCGGCTCTGCTGCCGACATCCCCATCAACATCTCAGAGAC GGATCTCAGCCTGCTCGTACGGCCACTGTGGTCCCGCCCTCGGGCCGCGAGGAGCCCTGTCT GCTGAAGCGGCTGCGCAATGGCCACGTGCGCATTGCATTCGTGCCCAAGGAG | SEQ ID NO: 1490 |
| FLNA | ADXCRPD.3150.C3_at | CTCATGGGTCTTGCCCGATGGGCTGGTCACCTGGGCTGTCATATCCTGGATGCTAATTTCAG GGATTTTCAGGCTGAGGTCACAATGACTACCAACGTTGGCCACTGAAGGAGCCCGACGCCTG CGGGTGATGCTCTCTTTCACCCGGCCCTCGCCTGTCACCTTCACAGAGAAGGGGCTGCCAGG CACGTGCTGGTCGGCAAACTTGATGTTGATGATGTAGTTGCCTGGCTCTGTGGGGCAGTAGG TGACCCTGCACGTCC | SEQ ID NO: 1902 |
| FLNA | ADXCRPD.3227.C1_at | TTCACCCTGTCTGGGTGGAAGTCCTGGGGCGCGTCACGGATGTCAGCCATGAAGGGGCTGAG GCGGATGTCTTCGCTGTTGCACAGCACGTGAACGGCATACTCGCCAGCCTCCTGCGGCCAGT AGCGCACATCACAGGAGCCGTCGCCCTTGTCGTCACATTCGATCTTAGCCTGCGATGGCCCT TCCACCGAGAAGCCCAGCGTGCCCACGTCGTCCCCGATAGCCTCCACCACAAAGTCTGCTGA CTTGCCAACGACG | SEQ ID NO: 1542 |
| FLNA | ADXCRPDRC.16964.C1_at | AAAAGTGACCGCCAATAACGACAAGAACCGCACCTTCTCCGTCTGGTACGTCCCCGAGTTGA CGGGGACTCATAAGGTTACTGTGCTCTTTGCTGGCCAGCACATCGCCAAGAGCCCCTTCGAG GTGTACGTGGATAAGTCACAGGGTGACGCCAGCAAAAGTGACAGCCCAAGGTCCCGGCCTGG AGCCCAGTGGCAACATCGCCAACAAGACCACCTACTTTGAGATCTCCACGGCAGGAGCTGGC AC | SEQ ID NO: 2051 |
| FLNA | ADXCRPDRC.3150.C3_s_at | GTCTCGTCAGCAACCACAGCCTCCACGAGACATCATCAGTGTTTGTAGACTCTCTGACCAAG GCCACCTGTGCCCCACAGCATGGGCCCCGGGTCCTGGGCCTGCTGACGCCAGCAAGGTGGT GGCCAAGGGCCTGGGGCTGAGCAAGGCCTACGTAGGCCAGAAGAGCAGCTTCACAGTAGACT GCAGCAAAGC | SEQ ID NO: 2048 |
| FLNA | ADXCRPDRC.3227.C1_at | AGAAGACAGGTGTGGCCGTCAACAAGCCAGCAGAGTTCACAGTGGATGCCAAGCACGGTGGC AAGGCCCCACTTCGGGTCCAAGTCCAGGACAATGAAGGCTGCCCTGTGGAGGCGTTGGTCAA GGACAACGGCAATGGCACTTACAGCTGCTCCTACGTGCCCAGGAAGCCGGTGAAGCACACAG CCATGGTGTCCTGGGGAGGCGTCAGCATCCCCAACAGCCCCTTCAGGGTGAATGTGGGAGCT GGCAGACACCCCAACAAGGTCAAAGTAT | SEQ ID NO: 1960 |
| FOXN3 | ADXCRAD_BM995629_s_at | CCGTGTAGGTCTATTGGCCAGCCAAGGTCAGACGACCCTAAGCATCAATAGTAAACCTCTTG GTCTTCTGATTGCTTTATCACTTTTTTTTTTTTTCTGTAAAACAAAACAAAACTCAGAAATG TTACAGAATCAGAGTATTAAAAAATGTACAAGTGTATATGCTTCCCAGACACACATGGATAC ATTTTTCCTCCACATTTTCACCATGGCAGTATTAAGTAGTGAGTGTGAATGACACAGCATGA AACTGGTTACTGAATCAGCTATGAGCTCAGATGGCCTCAAC | SEQ ID NO: 2480 |
| FOXN3 | ADXCRAD_BP254636_s_at | CATCTTGTGGCTCCCCAGTGGTCAGCGGAGACCCCAAGGAGGATCACAACTACAGCAGTGCC AAGTCCTCCAACGCCCGGAGCACCTCGCCCACCAGCGACTCCATCTCCTCCTCCTCCTCCTC AGCCGACGACCACTATGAGTTTGCCACCAAGGGGAGCCAGGAGGGCAGCGAGGGCAGCGAGG GGAGCTTTCGGAGCCACGAGAGCCCCAGCGACACGGAAGAGGACGACA | SEQ ID NO: 2438 |
| FOXN3 | ADXCRAD_CR735795_s_at | TGGACGTTGGACTGTTCATGCGCATCGGGTGTCAGTGACTCATGGAGAAGAAATGGGGTAAA TTTTTAGTGATGTTGCTAATCATTGAATTCTGTTCTCTATTAAATTAAGAAAATGTTCCAAA AGCCATAAGCCTGAAGATTGGCCCTGTGCACGCACGCACACACACACACACACACACACACA CACACACACACGAAGGAGAGAGAGAGAAAACTGATGGGGAAAACAAGCTGTGTCTTCTTA ACTGCCCAAGTGAAAAGCAACCAAGTCCAGGAAATTACAATAGCTGTT | SEQ ID NO: 1073 |
| FOXN3 | ADXCRAG_AF138861_s_at | GGTTCATTTTAGTTTCAGATAGATGGCTTCACCAAAGAACTCTTGAAAGAATACTGATTAGG GAGGGGCAGGGAAGTAGGAGCTTATGGTATATTATAAGGCTGGGAAAAATCTATGATGCAAA CCCTTTCCACATAGTACT | SEQ ID NO: 865 |
| FOXN3 | ADXCRAG_U68723_at | TTTTTCTGTCTATCAAAACTATTTGATCCAAGTGAAAAAAAAAAAAAAACTAGAAAGCTACGG AACCTGCAATGCGGCCG | SEQ ID NO: 1072 |
| FOXN3 | ADXCRPD.10462.C1_s_at | GTTCTGTTATGTTCATGTAAACCTAAAGAAACAGTGTGGAGGCAGGCGCGATCAGCCGAACT CTAGGGACTTGGTGTTGCTTGGAAGGCATCCATACCTGCATTTTGCATTCTTCGTATGTAAT CATATTGCCAAAGACAAACTATTTCATCATTTATTGTAAATAACACTTTTCCCCAGACCTAC CATAAAGTTTCTGTGATGTATTGTCTTCCAGTTGCAAT | SEQ ID NO: 1418 |
| FOXN3 | ADXCRPD.12156.C1_at | CCGAGCTGACGAGTCATAGATGCATAATTGCAAGATATAACCAGTAGGAGAGAGAGAATACAC AAGGAGTATAACCACCATCGGCGGTGCTCTCTCAAAAGGA | SEQ ID NO: 1511 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| FOXN3 | ADXCRPD.12156.C1_s_at | AAGGTGCAGCACCATAGACACATCGGTTTCGGCTGTTAAAAGATGGATCGTTTTAAAAACTG TGTTTTCCTTCCTTAATTTTTGGTCAGTGAAGCTAGCACTTGTTTTGCTGAACTGTGGAAGAA CTGCAAGGTCACACACATTATTCATGATAAAGCAACCGAGCTGACGAGTC | SEQ ID NO: 1512 |
| FOXN3 | ADXCRPD.8652.C1_at | TAATCGGATGTCAGGCAGAGAAAACGTCGAGGTCACTCGTCTTCCTGAAGGGCCTTGGAGAA ACCGCTGCCCCCGTAACACTGACTCAGTCCACTGGAGACACTAATTCCTGAGCTTTCTGGCT TCTTACTGGGAGGCATGACTGGACCCATTTACGTGAAGGCTCCTGGCCGGACGGGGCACGG GGGTGCGGGGGCGCCGCTGCCCTTCAGCAGGAGCCGACAAACTTTCGCGGGCG | SEQ ID NO: 1405 |
| FOXN3 | ADXCRPD.8765.C1_at | TCTTGAAGAAGGTACTGCCCGGCCAGATGGGTGGACCTGATGTGCTTTGATATGCCTGAGGA CAGGTGGGAGGTGTATTGAACACGTGTGGGTGTGGGTGATAAGGTGTCTTTTTCAAAGCCTG AATTAGATTTTGTCTATACTCTGGGTCTATGCACCACAACGACCCTTTCCCAATACTCTGAC TCCTCTCTTTGTCCACTTTCTTAAAACACTTATTCAATGATAAATTGTGTCTCACTGAGTTT TTCCACCCAGTAGGTGCATTTGCAAAAT | SEQ ID NO: 1423 |
| FOXN3 | ADXCRPDRC.12156.C1_at | GTGAACGATCATTTCTGACTTAACCGTGAGATGCTCACGAGTACCCTTCCTGTTGTTTTGTT AGCATTGAAATCGAGACTATTTATTGGAATATATACAACAGTGTTTTTCCACTGTATTTCA TTTGCAAAAGTTGAGAACTGCTTTCTCTACCCTTTGCCAAATTAATGAATATCCAATATGGG ATTTTCAAAGACTCCGATATGGTGAACCTATTAAACCTAGAAATTGTATTCATCCTTTCATG ACTGTGGCCTGAGTTCCCCAG | SEQ ID NO: 1953 |
| FOXN3 | ADXCRPDRC.8652.C1_s_at | GAGCCTTCACGTAAATGGGTCCAGTCATGCCTCCCAGTAAGAAGCCAGAAAGCTCAGGAATT AGTGTCTCCAGTGGACTGAGTCAGTGTTACGGGGCAGCGGTTTCTCCAAGGCCCTTCAGGA AGACGAGTGACCTCGACGTTTTCTCTGCCTGACATCCGATTATAAGAAGGGGGCCATGGAAG ATGAAGAGCTGACCAACCTGAACTGGCTGCACGAGAGCAAGAACTTGCTGAAGAGCTTTG | SEQ ID NO: 1924 |
| FOXN3 | ADXCRPDRC.8765.C1_s_at | AAAGGGTCGTTGTGGTGCATAGACCCAGAGTATAGACAAAATCTAATTCAGGCTTTGAAAAA GACACCTTATCACCCACACCCACACGTGTTCAATACACCTCCCACCTGTCCTCAGGCATATC AAAGCACATCAGGTCCACCCATCTGG | SEQ ID NO: 1928 |
| FTSJ1 | ADXCRAG_BC023584_s_at | GGGTAACCATGAACTTGATGGAAGAAAATGTTACATCTTTATTTTCAGCAATGAAACTGAAA TTTAGCCTTACTCCCAAGTTATAAATGCTGGCAACAAATCACAGTAGTAAAAGCAGTACCTG GGATTTTCCCACCAATACAAACCAGTTACAGCAACTGTAATGTAACATAAAAAGGGCATCTT GAAGTATTGTTCATATTTGTCACCTCTTGGAATGATAGCAGATCCTGTAAGTTGATGTATTA ATTAAAAAGCCCATATATTACTGCATCTCAA | SEQ ID NO: 949 |
| FTSJ1 | ADXCRPD.6080.C1_at | ATCCACACAGAAGTGCGGACACCGTTTTTNNNNNNNNNNNNNNNNNNNNNNNNNTCCGAG TGGCCCACGCCCTTTGGTGGGGCCCCCTGGAGAATGGGGCAAACACCCCCGGATATATGTAC CGCGTGTCCCCCCTCACCCCCACCTACGGTGTGGGCCAATTTGGCACCCCATTCTCCAAAAA CGGGCTCCAACGCGCACCGCAAAAAACCCGCCAATCTGTGATGATAGAACTTTCGGTCTCTA AAAGAATCCCACCAATTATACCGAGGGACCTTG | SEQ ID NO: 1704 |
| FYN | ADXCRAD_CB268908_s_at | AAGAGTGCCATACCCAGGCATGAACAACCGGGAGGTGCTGGAGCAGGTGGAGCGAGGCTACA GGATGCCCTGCCCGCAGGACTGCCCCATCTCTCTGCATGAGCTCATGATCCACTGCTGGAAA AAGGACCCTGAA | SEQ ID NO: 2574 |
| FYN | ADXCRPD.4372.C1_s_at | CCCAAATCCGAACCTCCTCTGTGAAGCATTCGAGACAGAACCTTGTTATTTCTCAGACTTTG GAAAATGCATTGTATCGATGTTATGTAAAAGGCCAAACCTCTGTTCAGTGTAAATAGTTACT CCAGTGCCAACAATCCTAGTGCTTTCCTTTTTTAAAAATGCAAATCCTATGTGATTTTAACT CTGTCTTCACCTGATTCAACTNNNNNNNNNNNNNNGTATTATTTTTCCAAAAGTGGCCTCTTTGT CTA | SEQ ID NO: 1630 |
| FYN | ADXCRPD.8770.C1_at | GCGCGTCGTTGCAGTTGCGCCATCTGTCAGGAGCGGAGCCGGCGAGGAGGGGCTGCCGCGG GCGAGCAGCAGGGGTCGCCGCGAGCCGAAGGCCTTCGAGACCCGCCCGCCGGCCGGCGGCGA GAGTAGAGGCGAGGTTGTTGTGCGAGCGGCGCGTCCTCTC | SEQ ID NO: 1426 |
| GRB10 | ADXCRAD_BG258819_at | AAGATCAGCGGAAACGTTGAAAATAACTGGAATGATCATCTGGGGTGGGCCGCTACGAACAG AACCGCAAACAGGATGGCATGAATCTTGCCCTGGATATCTGACATTACACGGACTGTCACTA ACGATGACACC | SEQ ID NO: 2496 |
| GRB10 | ADXCRAD_BI833263_at | GGGCGCGGCGCCAAAAAGCAGACCCCGAAGAGAGAGCCGCATAGGCACAAGAGGCCACAGCC AGATACCAACGGACAACAAGCTGGGCAAACAAATGGCGACACGACCGACGGAAAAAACCACG AGGAGACACAGCCAACCCAGACGACAAACCCGAGACACGCCGCCCACAAGACAGGGAACCAC AAGCACCCCGACCGGGAGGCACACTCAAAGGACGCCGCACCCACCCACACAGGCAGGAGAGC GCCGACCGCGGCAACAAGAGCACCCAGA | SEQ ID NO: 2507 |
| GRB10 | ADXCRAG_NM_001001549_s_at | AAGCTGGCGGTAGATTTGTGATGTCACAGTGCAAACTGCAGTGACTGTAAATTGGCTGGCG TGTATAAACGTTTTCAGGGAATGCAGAAGGTATTAATGAAGAGACAAAACCTTTATTCCATG TGCTTTGCTTCATTCTGTACATAGCTCTTTGGCTCGTGAACCTAATTGTAAACTTTCAGGTA TTTTTGTACAAATAAGGGACTGATGTTCTGTTTCTTGTAATT | SEQ ID NO: 1007 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| GRB10 | ADXCRPD.15300.C1_at | CAGAGGTGTGAAGGCTCGCCATAGAGGAGGGCTTGTTGAGTGTCACTCCTGGAGCCTACGGA GTCGCAGGGAGGCCTGGCATGGTCAGGTAGACTTGGTAAGGCCTGACTGCTGGGGAATGTAT CCTGCCAATAGATTCCTGGGCCTGGAACAGCTCTTCTTTGGACACATGCCATCCATCTTTGG AATAAGACAATCTGGCATTTATGTACCTGGTGGGTTACC | SEQ ID NO: 1740 |
| IFRD1 | ADXCRAD_BI823993_s_at | TGTCGAGATAAGAGAGCAGATGTTGGAGAATTCTTCTAGATTTTCAGAACTTGAAGACTATT TTCTAATTTCTATTTTTTTTCTATTTCAATGTATTTAAACTCTAGACACAGTTTTTATCCT GGATTAACTTAGATAACTTTTGTAGCAGTGGTTATATTGCTT | SEQ ID NO: 2616 |
| IFRD1 | ADXCRPD.4641.C1_s_at | CCTGTCACTGGCATCAACAAAAGGAATTATACCATGAGACCTTATAGCTGTACTTAAAAGCC ATTCAGTTCAGCTATTGGGAGTTCATGATGAATTAGCATATGCCAGAAAGGTTGCTAACCTT AACATCTGAGAGCAGTAACAC | SEQ ID NO: 1690 |
| IFRD1 | RDCR181_H11_at | CTGTCCGTGTTTATTGCAGTTCTCTGGTTTGTCTGGAGTGTTTGCAAGTCAGTCATCATAGT GGCAGCTTCCGCCTGCTACAGGATATTTATATATGGAAGCATACCATGGCAGGAGTGCTGGA AAGGTGGTGTCAGCTAACAGTTGCTTCAGCCAGATAAGGACGGTAACTTCAGTCCAATAAAA AACCTCATCAGTTACCAACTAAATCAAGGCAT | SEQ ID NO: 1352 |
| IFRD1 | RDCR181_H11_x_at | TGTCCGTGTTTATTGCAGTTCTCTGGTTTGTCTGGAGTGTTTGCAAGTCAGTCATCATAGTG GCAGCTTCCGCCTGCTACAGGATATTTATATATGGAAGCATACCATGGCAGGAGTGCTGGAA AGGTGGTGTCAGCTAACAGTTGCTTCAGCCAGATAAGGACGGTAACTTCAGTCCAATAAAAA ACCTCATCAGTTACCAACTAAATCAAGGCAT | SEQ ID NO: 1353 |
| IL6ST | ADXCRAD_AU280467_s_at | GATAACAGTTACTCCAGTATATGCTGATGGACCAGGAAGCCCTGAATCCATAAAGGCATACC TTAAACAAGCTCCACCTTCCAAAGGACCTACTGTTCGGACAAAAAAAGTAGGGAAAAACGAA GCTGTCTTAGAGTGGGACCAACTTCCTGTTGATGTTCAGAATGGATTTATCAGAAATTATAC TATATTTTATAGAACCATCATTGGAAATGAAACTGCTGTGAATGTGGATTCTTCCCACACAG AATATACATTGTCCTCTTTGACTAGTG | SEQ ID NO: 2508 |
| IL6ST | ADXCRAD_AV662263_s_at | CTGATGTAAGTGTTGTGGAAATAGAAGCAAATGACAAAAAGCCTTTTCCAGAAGATCTGAAA TCATTGGACCTGTTCAAAAAGGAAAAAATTAATACTGAAGGACACAGCAGTGGTATTGGGGG GTCTTCATGCATGTCATCTTCTAGGCCAAGCATTTCTAGCAGTG | SEQ ID NO: 2434 |
| IL6ST | ADXCRAD_BQ887381_at | AGGGATTTTTACCACATGAAAGTCATTCCAGTGGACCCTAACCTCCTTATTGGTGGAAGG TTAGTG | SEQ ID NO: 2658 |
| IL6ST | ADXCRAD_BQ887381_s_at | TTTTACTATGGATCAGTCGGCACTCGGGAACAGCAGCAAGGAAAAAAAGCAAATTTCATTC ACATGTTC | SEQ ID NO: 2659 |
| IL6ST | ADXCRAD_BQ887381_x_at | TTTTACTATGGATCAGTCGGCACTCGGGAACAGCAGCAAGGAAAAAAAGCAAATTTCATTCA CATGTTCTGGGTTCATACCTCTTCTCTACCTAATTGGTCATTTTAAATTTCCAGCCTTATTC CCTGGATAAGGGATTTTTACCACATGAAAGTCATTCCAGTGGACCCTAACCTCCTTATTGGT GGAAGGTTAGTG | SEQ ID NO: 2660 |
| IL6ST | ADXCRAD_CN265168_s_at | AACAGTTGGCATGGAGGCTGCGACTGATGAAGGCATGCCTAAAAGTTACTTACCACAGACTG TACGGCAAGGCGGCTACATGCCTCAGTGAAGGACTAGTAGTTCCTGCTACAACTTCAGCAGT ACCTATAAAGTAAAGCTAAAATGATTTTATCTGTGAATTCAGATTTTAAAAGTCTTCACTC TCTGAAGATGATCATTTGCCCTTAAGGACAAAATGAACTGAAGTTTCACATGAGCTATTTC CATTCCAGAATATCTGGGATTCTACTTTAAGCACTA | SEQ ID NO: 1054 |
| IL6ST | ADXCRPD.11859.C1_at | AAATGCTTGGCCTAGAAGATGACATGCATGAAGACCCCCCAATACCACTGCTGTGTCCTTCA GTATTAATTTTTTCCTTTTTGAACAGGTCCAATGATTTCAGATCTTCTGGAAAAGGCTTATT GTCATTTGCTTCTATTTCCACAACACTTACATCAGTGAAATTGCCATCTGAATCATTTGAT CTTCCGAATTAAAATTGTGCCTTGAGGAGTGTGAGGTGACCACTGGGCAATATGACTCTTT GAAGGATCTGGAACATTAGGCCAGATGTGTAAACAATTAGGTCTCGCTTAT | SEQ ID NO: 1581 |
| IL6ST | ADXCRPD.13648.C1_at | GATAGACCATCTAAAGCACCAAGTTTCTGGTATAAAATAGATCCATCCCATACTCAAGGCTA CAGAACTGTACAACTCGTGTGGGAGACATTGCCTCCTTT | SEQ ID NO: 1687 |
| IL6ST | ADXCRPD.13648.C1_x_at | ATATGTGTATAGGATTCGCTGTATGAAGGAAGATGGTAAGGGATACTGGAGTGACTGGAGTG AAGAAGCAAGTGGGATCACCTATGAAGATAGACCATCTAAAGCACCAAGTTTCTGGTATAAA ATAGATCCATCCCATACTCAAGGCTACAGAACTGTACAACTCGTGTGGGAGACATTGCCTCC TTTTGAAGCCAAT | SEQ ID NO: 1688 |
| IL6ST | ADXCRPD.14481.C1_s_at | TGTTTACTAACATATATTGACCAAGTACATCAAGCAGGAGAGATCTTCCTTCATTCTGTTAT AGTCCACATCATTCTAATTTTGCTCAGTTGTTATTAAGAGCATATTCCTAAACCATACACTT TTGTTTCAATAAAGTTTTATTTTGTTGAGATGAATAAAATAACAAAGTTATAAGCTGCATAA GACAAAAGTTCAATT | SEQ ID NO: 1707 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| IL6ST | ADXCRPDRC.11859.C1_s_at | ACACTTCGAGCACTGTCCAGTATTCTACCGTGGTACACAGTGGCTACAGACACCAAGTTCCG TCAGTCCAAGTCTTCTCAAGATCCGAGTCTACCCAGCCCTTGTTAGATTCAGAGGAGTGGCC AGAAGATCCTACAATTAGTAGATCATGTAGATGGCGGTGATGGTATTTTTCCCAGGCAACAGT ACTTCAAACAGTACTGCAGTCAGCATGAATCCAGTCCAGATATTTCACATTTTGAAAGGTCA AAGCAAGTTTCATCAGTCAATGAGG | SEQ ID NO: 1971 |
| JUN | ADXCRAD_AJ712294_s_at | AGGAAGCGCATGAGGAACCGCATCGCTGCCTCCAAGTGCCGAAAAAGGAAGCTGGAGAGAAT CGCCCGGCTGGAGGAAAAAGTGAAAACCTTGAAAGCTCAGAACTCGGAGCTGGCGTCCACGG CCAACATGCTCAGGGAACAGGTGGCACAGCTTAAACAGAAAGTCATGAACCACGTTAACAGT GGGTGCCAACTCATGCTAACGCAGCAGTTGCAAACATTTTGA | SEQ ID NO: 2719 |
| JUN | ADXCRAD_NM_002228_s_at | CAGCCCACTGAGAAGTCAAACATTTCAAAGTTTGGATTGTATCAAGTGGCATGTGCTGTGAC CATTTATAATGTTAGTAGAAATTTTACAATAGGTGCTTATTCTCAAAGCAGGAATTGGTGGC AGATTTTACAAAAGATGTATCCTTCCAATTTGGAATCTTCTCTTTGACAATTCCTAGATAAA AAGATGGCCTTTGCTTATGAATATTTATAACAGCATTCTTGTCACAATAAATGT | SEQ ID NO: 2694 |
| JUN | ADXCRIH.716.C2_at | GATGAAAAGCTGATTACTGTTCAATAAACAGCTTCCTGCCTTT | SEQ ID NO: 1287 |
| JUN | ADXCRIH.716.C2_s_at | CAAACTGCAATAGAGACTGTAGATTGCTTCTGTAGTACTCCTTAAGAACACAAAGCGGGGGG AGGGTTGGGGAGGGGCGGCAGGAGGGAGGTTTGTGAGAGCGAGGCTGAGCCTACAGATGAAC TCTTTCTGGCCTGCCTTCGTTAACTGTGTATGT | SEQ ID NO: 1288 |
| JUN | ADXCRPDRC.3805.C1_s_at | AACTTGTGCGCGCAGCCCAAACTAACCTCACGTGAAGTGACGGACTGTTCTATGACTGCAAA GATGGAAACGACCTTCTATGACGATGCCCTCAACGCCTCGTTCCTCCCGTCCGAGAGCGGAC CTTATGGCTACAGTAACCCCAAGATCCTGAAA | SEQ ID NO: 2045 |
| KIF2C | ADXCRAD_CV804054_at | GCAGCCTGAAAAGCAGGCTAGCAGACAAATAAACAGCAAGAAAACGGCCCCATTGACGACTG GCAATAAAAAT | SEQ ID NO: 2651 |
| KIF2C | ADXCRAD_CV804054_s_at | CTGGAGACCTTTGTGAACAAAGCGGAATCTGCTCTGGCCCAGCAAGCCAAGCATTTCTCAGC CCTGCGAGATGTCATCAAGGC | SEQ ID NO: 2652 |
| KIF2C | ADXCRPD.737.C1_s_at | AGCATCCTGCCTGCGTGGACTGGCTGCTAATGGAGAGCTCCCTGGGGTTGTCCTGGCTCTGG GGAGAGAGACGGAGCCTTTAGTACAGCTATCTGCTGGCTCTAAACCTTCTACGCCTTTGGGC CGAGCACTGAATGTCTTGTACTTTAA | SEQ ID NO: 1607 |
| LEPRE1 | ADXCRAD_CN309928_s_at | AGACGGATGGGTGACTAGACCCATGGAGAGGAACTCTTCTGCACTCTGAGCTGGCCAGCCCC TCGGGGCTGCAGAGCAGTGAGCCTACATCTGCCACTCAGCCGAGGGGACCCTGCTCACAGCC TTCTACATGGTGCTACTGCTCTTGGAGTGGACATGACCAGACACCGCACCCCCTGGATCTGG CTGAGGGCTCAGGACACAGGCCCAGCCACCCCCAGGGGCCTCCACAGGCCGCTGCATAACAG CGATACAGTACTTAAGTGTCTGTGTAGACAACCAAAGAATAA | SEQ ID NO: 1914 |
| LEPROT | ADXCRPD.1565.C1_at | TTGCCTGCCAACACAAGGCCGCAGTCCCCATTTGATCACAGCCACACGAGCAAGAATAACAG GAAATCCAAAGGCAGAAACAACAATTCCAGTAGTGAAAGAAATCCAGTTCCCGACAGGCA CTACTGGTTGCATCTGAGTCATAGGTGACTCTTTTGGCAATGAAATGGGGGATGGGGGAGAT GGCGTGGAAAATCAGGACGAATAAGGGCCAGTAAACGCCATAATCCTCTAAGGCACATCCCA GCATAAGAAAAGTCAGTCCAATAGCCCCACTGAAGGATAATGGCCCGA | SEQ ID NO: 1442 |
| LEPROT | ADXCRPDRC.1565.C1_s_at | CTGAAGCCCCACTCTGGACCCAGGACATTTTGATGAGATCCAAAGGAGTTGTATGCACATGA AAGTTTGAGAAGCATCATCATAGAGAAGTAAACATCACACCCAACTTCCTTATCTTTCCAGT GGCTAAACCACTTAACCTCTCTGGGTGTTACCTGCTCATTTGTTT | SEQ ID NO: 1933 |
| LGALS1 | ADXCRIH.2899.C1_at | GAAAGACAGCTCCCGCTGCTCGGTCCCCCAGGCCCCGCCGTCCTTGCTGTTGCACACGATG GTGTTGGCGTCGCCGTGGGCGTTGAAGCGAGGGTTGAAGTGCAGGCACAGGTTGTTGCTGTC TTTGCCCAGGTTCAGCACGAAGCTCTTAGCGTCAGGAGCCACCTCGCCTCGCACTCGAAGGC ACTCTCCAGGTTTGAGATTCAGGTTGCTGGCGACCAGACCACAAGCCATGATT | SEQ ID NO: 1181 |
| LGALS1 | ADXCRIHRC.2899.C1_at | AACACCATCGTGTGCAACAGCAAGGACGGCGGGGCCTGGGGGACCGAGCAGCGGGAGGCTGT CTTTCCCTTCCAGCCTGGAAGTGTTGCAGAGGTGTGCATCACCTTCGACCAGGCCAACCTGA CCGTCAAGCTGCCAGATGGATACGAATTCAAGTTCCCCAACCGCCTCAACCTGGAGGCCATC AACTACATGGCAGCTGACGGTGACTTCAAGATCAAATGTGTGGCCTTTGACTGAAATCAGCC AGCCCATGGC | SEQ ID NO: — |
| LHFPL2 | ADXCRAG_AY309920_s_at | CTGGGATTTCTTCTGAGACTGTGGTGAAACTCCTTCCAAGGCTGAGGGGTCAGTAGGTGCT CTGGAGGGACTCGGCACCACTTGATATTCAACAGCCACTTGAGCCAAATATAAAATTGTATT TACAGCTGATGGACTCAATTTGAGCCTTCAAACTTGTAGTTATCCTATTATATTGTAAACTA ATACATTGTCTAGCATTGATTTGGTTCCTGTGCATATGTATTTTCACTATGTGCTCCCCTCC CCAGATCTTAATTAAACCAG | SEQ ID NO: 905 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| LHFPL2 | ADXCRPD.5554.C1_at | AGAAGAAATCCCAGTCGTGCCTTTAACTCTTTTGGCCCTTGGGAGTCATTGCAACCCCAATA CAAATGCCGGCCCAGGGATTTCCAGTGGCCACAAGTTATTGCACAGAGAGGTCTGTTCTAAG CCAGACTCTTACAGCTAAGGAGGTGTGAGATTAGCCCTTAAATACTGGTCTGTAGCATTAGCAT GGTCTATAAAAGCATGTTAAGAAATAGCTCCTCAGTGATTATGTACCAGCTACTAGTTATCC TACTAAGAGAAAAGGCAACATGGCAGCTTCACATTTC | SEQ ID NO: 1723 |
| LHFPL2 | ADXCRPDRC.5554.C1_at | AAATATCTTGCGTTAGCGTGAAAGTATGTTGANTTAACACGGGGAGCCCGCCCCGAACTACC ATGCAAGAACCCCCGCCGAAAAACGAGACTTTTGTGTATCGCCGTGATGTCGGGGCGGTGGG GAACACTCGCCGGCGGGTGGCANAGCGCGGGGGTGGCACAAAGATTGATTACCCCGCAATAA GACCGGCCCGATCGTGCAACACGGCGCGTCTTCATTCTCGCGCCACAACCCCTATATTATTG TTCTCATCAGCGACGGTTCTTTGTACGACAATGCACACGG | SEQ ID NO: 2008 |
| LHFPL2 | ADXCRSS.Hs#S1449485_at | TACTTCCATGCATCAGATTTATGACAAAAGCAATTATATAAGCAGCAAAGGCAAAACCCCCA CGTGTCTGTCTCTGCTTTTCCTTTTATTGCTTTTTTTCATGTGGGCCTCTTTCACCCTCAAT CATTGCTCACTTCCAAGAAGGCTGAGCCTGCATACACCAGGCCCTTCACCACCACTGCCAGC GCCATTCCCACGACCACACACCCTTCACCCCAGCCCTGCAGAGGCAGGGTTCAGCCCCAGGG CAATCTATCTGGTCAGACTGGTGG | SEQ ID NO: 2070 |
| LIMA1 | ADXCRAD_BP321052_s_at | GACCATCCTCCTGCTGAAGTGACAAGCCACGCTGCTTCTGGAGCCAAAGCTGACCAAGAAGA ACAAATCCACCCCAGATCTAGACTCAGGTCACCTCCTGAAGCCCTCGTTCAGGGTCGATATC CCCACATCAAGGACGGTGAGGATCTT | SEQ ID NO: 2752 |
| LIMA1 | ADXCRAD_BX365807_s_at | TTTTTATCACAGTATTCTCAGGGTGAAATTAAACCAACTATAGGCCTTTTTCTTGGGATGATT TTCTAGTCTTAAGGTTTGGGGACATTATAAACTTGAGTACATTTGTTGTACACAGTTGATAT TCCAAATTGTATGGATGGGAGGGAGAGGTGTCTTAAGCTGTAGGCTTTTCTTTGTACTGCAT TTATAGAGATTTAGCTTTAATATTTTTTAGAGATGTAAAACATTCTGCTTTCTTAGTCTTAC CTAGTCTGAAACATT | SEQ ID NO: 1229 |
| LIMA1 | ADXCRAD_CD653165_at | AACACAAAAACCTTCTAATCTAGAGATACTTACTAATCTCATTACATGAGAATGCTATGCTG TAGTGTACTGGGATATCACTGAATACCAATCATGATCCAAGATATAGA | SEQ ID NO: 2337 |
| LIMA1 | ADXCRSS.Hs#S1914330_at | CCTCGCTAACACTTGTCAAACTATATTTTAACTATACCCCACAATAAGAAATATTTTACATT CCTACTCAGTTTATACACATACAAATAACTGAAACAAAAACTTTAGAAAAAACCTACCTATA CTATGTCTGATGCACTTTGACATTTTCGATTGCATTCTGTTCTTTTTCATCAAAACAAACAT GTTGCTTCTGATCGCTCAAGTTGCTTTTACA | SEQ ID NO: 2087 |
| LIMA1 | ADXCRSS.Hs#S3738155_at | TTCTCTATGTTGCCTCACTTTATTTCTGAGAAAATAGTTGTTACATATCATTTCTTCCAAGT AACTCAAAGTGCAAATATAAATGTGACAAATCGGGGAAACATTCCAAATTAACTCATTTTAA TCATAGAGTCTTACAGAAGGAAGTAACCAAGATGTCACTTTCTCCAGCTTTCCTTTCTGAGC AATCCTTCCTAAAATACTCTTGAAAGATGTTTTGGCATCTGTGTGACATTTCTAGCTATTAG ATAGCTCTAGCTAGACAGCTTCTCC | SEQ ID NO: 2105 |
| LIMA1 | ADXCRSS.Hs#S3738155_x_at | TAGCCCCTGGAGAGCATGTCTTTTTCTCTATGTTGCCTCACTTTATTTCTGAGAAAATAGTT GTTACATATCATTTCTTCCAAGTAACTCAAAGTGCAAATATAAATGTGACAAATCGGGGAAA CATTCCAAATTAACTCATTTTAATCATAGAGTCTTACAGAAGGAAGTAACCAAGATGTCACT TTCTCCAGCTTTCCTTTCTGAGCAATCCTTCCTAAAATACTCTTGAAAGATGTTTTGGCATC TGTGTGACATTTCTAGCTATTAGATAGCTCTAGCTAGACAGCTTCTCC | SEQ ID NO: 2106 |
| LOX | ADXCRAD_CV574618_s_at | TAGAAGGCAAAGCAAAACTCCCAATGGATAAATCAGTGCCTGGTGTTCTGAAGTGGGAAAAA ATAGACTAACTTCAGTAGGATTTATGTATTTTGAAAAAGAGAACAGAAAACAACAAAAGAAT TTTTGTTTGGACTGTTTTCAATAACAAAGCACATAACTGGATTTTGAACGCTTAAGTCATCA TTACTTGGGAAATTTTTAATGTTTATTATTTACATCACTTTGTGAATTAACACAGTGTTTCA ATTCTGTAATTACATATTTGACTCTT | SEQ ID NO: 1013 |
| LOXL2 | ADXCRAD_BI825165_at | GGAATAACAAGAAAGATCTATGAACAGAACACAAACAAACACAGCAAGCTAACAAAA | SEQ ID NO: 2695 |
| LOXL2 | ADXCRAD_CF619371_at | CCATGGTGGGTCTGCCCGCCAGCTGGGCCTTGGGAATTCGCCCACCAAACGCCTTTCAAGAA AACCTTGGTTATTGGGCCCCGGAAGATGTTCAACAGCCCAACAA | SEQ ID NO: 2405 |
| LOXL2 | ADXCRAG_AF117949_s_at | GAAACTTGTCAGAAGGCATAGGAGTTGTGCGAGGGCTGGATGGGAAGTCTAGATTTAAACAG CCACCAGGCAGCTTATCAAAGCAAGAGGGCATCCGTTCACAGGACAGGGCTCCCAGCAATT CCCAGTGGCAGTGGGGGGTGGCTGGCCCAAGCCCCAAGTCACCCAGACACAGGGGACTTCCC CTTGTGTCAACAGCATGTAGGGCCCAGCAAATAGAGGGTAGGTAGGACCACCTTGGCACC AA | SEQ ID NO: 858 |
| LOXL2 | ADXCRAG_NM_002318_s_at | CACCCCTTGTTTTTCAAGATACTATTATTATATTTTCACAGACTTTTGAAGCACAAATTTAT TGGCATTTAATATTGGACATCTGGGCCCTTGGAAGTACAAATCTAAGGAAAAACCAACCCAC TGTGTAAGTGACTCATCTTCCTGTTGTTCCAATTCTGTGGGTTTTTGATTCAACGGTGCTAT AACCAGGGTCCTGG | SEQ ID NO: 1014 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|------|----------------|----------------|-----------|
| LOXL2 | ADXCRPD.4590.C1_at | GGGTTGCTCTGGCTTGTACGCTTTCCGGAATCTCGAGGGTCCGTCAGGGCTGAAGACCTGCC CAGGCACACAACTCACCACGGCCGGTAGCCCATTCTCGCAGGTGACATTCTTCATGGGGTCC AGTGACACCTGGGGGCCCAGCTTGCAGCTGGAGATGTGGGCCTCTGTGCCGGTGCAGTCCAT GGAGAATGGCCAGTAGCGCTGCTTCCTCCGTGAAGCACACATTTTGTACACTTT | SEQ ID NO: 1674 |
| LOXL2 | ADXCRPDRC.4590.C1_s_at | ACCGTCTGCGACGACAAGTGGGACCTGGTGTCGGCCAGTGTGGTCTGCAGAGAGCTGGGCTT TGGGAGTGCCAAAGAGGCAGTCACTGGCTCCCGACTGGGGCAAGGGATCGGACCCATCCACC TCAACGAGATCCAGTCACAGGCAATGAGAAGTCCATTATAGACTGCAAGTTCAATGCCGAG TCTCAGGGCTGCAACCACGAGGAGGATGCTGGTGTGAGATGCAACACCCCTGCCAT | SEQ ID NO: 1997 |
| LPP | ADXCRAD_AI079544_at | GACCTAAAACTGTCTCCAGGACACAAGGCTATTCCAAGCAACATTAAGAGAGAGCTCTGTAG GAAAAGAGGGTCTTGTCAACACAATTCTCAGAATAA | SEQ ID NO: 2852 |
| LPP | ADXCRAD_AI079544_s_at | GGACTCACAAGTCATACCCTACTAAACACCCATCAGATGGACTTGTCTACTTTATTGAGAAA CAACAGAAGATAGACCTGCAAGTCCAGCTGTTCATCTACCTCCACCCCACAGCCCAAGCCAC ATTCCCACCCTTTGTGGATGAAGCTCAGGGATGCAGATCCCATTCCAAGATCC | SEQ ID NO: 2853 |
| LPP | ADXCRAD_AL833171_at | TTGGCCTATTCTGGACTGCAAATAGCATTGCCAAGCACTTCCCTTAAATAACTTCTCTTTTT TGCAGGACTATCCTCTCAGCCCTGCCAAAACCCCATCACCTACTCTTTCTTTACTACTTTGC CTATTTAATGCTGGAATTTTTATTTAAACTGTAGCTGATTTACTGAAGGTAATTAAGTGCTT TCATGCTGTAGATCTCCTGCTAGACTACAGGCTGTACTTGGGAGTGAGAGTGAACCAAATGT AA | SEQ ID NO: 2784 |
| LPP | ADXCRAD_BM456598_at | TTGTCTTGGAAGTATCTCATAGGTCTTTAAATGAGTAAAACATTTTTATGCCAGAAGGTGAT ATAATGGATGTTAGTGTTTTTTATTGGATTTTACAGGAGTTTTAGTCAGATAATGAGGACAG AGACCTCCACTTGAATTCTTTACCACCATTTCAGCAATATTTTTTAATGGCCTTTCACTTG GATTTTGGCTTAAATAAGGGCCCCGAACAAGATCCAAAACTTTGTGTCCTCAGGGAAGGGCC ATTAATA | SEQ ID NO: 2400 |
| LPP | ADXCRAD_BM456598_x_at | TTGTCTTGGAAGTATCTCATAGGTCTTTAAATGAGTAAAACATTTTTATGCCAGAAGGTGAT ATAATGGATGTTAGTGTTTTTTATTGGATTTTACAGGAGTTTTAGTCAGATAATGAGGACAG AGACCTCCACTTGAATTCTTTACCACCATTTCAGCAATATTTTTTAATGGCCTTTCACTTG GATTTTGGCTTAAATAAGGGCCCCGAACAAGATCCAAAACTTTGTGTCCTCAGGGAAGGGCC ATTAATA | SEQ ID NO: 2401 |
| LPP | ADXCRAD_CX867590_at | TCTTGATGGGCCTTTTGTCCCAGGACTTCCACATTT | SEQ ID NO: 2618 |
| LPP | ADXCRAG_BX648297_s_at | GTAGGGTATGACTTGTGAGTCCACAAGGCCAGCAGTATATATGCTGAATGGACTGCTTAGCA GTAACACACTGGAAAAATCCAAAAAGAATGGATTTCAAGTTGGCAAAAAATGCATTAGAAGT CAGCAGTGTGATGTGGTCAGGAGAACAACCAGAGTGACTGTGGGATGAGGTCTTGGATAGCT TTGTT | SEQ ID NO: 984 |
| LPP | ADXCRAG_NM_005578_at | AAATAAGTCATGTGTCCCAGCATAAGGCATCAGGTTGTTAGATGCTGGCATCTCTGCAGCTC AAAGATGTGGGTTCTTTTTCTTGTCATTAACACATTGTTATTTCTGTAGGACCAACTTCTCT GATCAAAATTACTTTTCTGGGTATGTGCTGATTAAGGGGGTGGACTTATCAACACTATAATT GTTCCCTATGAAAGATTCCACAGAGATGTTTATGGTGA | SEQ ID NO: 1031 |
| LPP | ADXCRPD.11183.C1_at | GAATGACCAACAATTTGGCTTTCCTAGAAAGAGAAGAGAATATCTGAATTCCCTGTAAACTG GTAAATCCTCTACCATCAGTCCTGAATTCTGAGGGGGCCTGATATTTAAGCAACAAAACTTA GAAGGTTCCACCTGTTATTCCTAGCTCTGTCACTAAAAATCGTGTCCAAACAGAGGTAATAC GAATGTGTTACCCGTTCCCGAAATTNNNNNNNNNNNNNNNNNNNNNNNNNNNNNNNNCCC AGAGCACAGAATGGATCCAGTGTAGTAGTGCAGGTGACCA | SEQ ID NO: 1437 |
| LPP | ADXCRPD.14604.C1_at | AATACCGAACTAATGGTCCTTGTCTCAATGACCTGCCTATCCTTTGTCCCTTCATGGGAATC TTCTCACAGATCAAGTTACTATGATCTACAAGGCCAGTTCCCATAGCCTCGTTCCACTTACA CACGATCTTAACCATTTCTGTCCAGTGGGAGTCACCCACTCACCTCCTAAAACCTCTATGCA TGCCCCATACCCCTAGTCATAATACTCTTATACAAATGTTTAACACTTTGCAGTTGAAGACC CAAT | SEQ ID NO: 1731 |
| LPP | ADXCRPD.16626.C1_s_at | CTAGATGATTCCAGTGCCCTTCCATCTATCTCTGGAAACTTTCCTCCTCCACCACCTCTTGA TGAAGAGGCTTTCAAAGTACAGGGGAATCCCGGAGGCAAGACACTTGAGGAGAGGCGCTCCA GCCTGGACGCTGAGATTGACTCCTTGA | SEQ ID NO: 1828 |
| LPP | ADXCRPD.16635.C1_at | TTAGTTAAGAACATGACCCGAAGAGTGAAAGGTATTTCCTGTTCCAAATAGGAGCCCAGTCT GCATTTTCTACTACATGATTAGTAGAAAGACACATTGCATTTGAACCATATTTCTTCTGCT AGCCAATTCCATCTTATCTACAACTTTTTGATAATTATTTTGAGAAATAGATCTAGATCACA GCCTTCCAATTCCTAGGCCAGGATACTT | SEQ ID NO: 1831 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| LPP | ADXCRPD.5328.C1_s_at | GAGCTATAGTACATGTGTGTTATGAATGAAATATGACAGCATGTTCCATACCCCTGCTTTAG CCATCTGTGGGAAACCAGCAAACTGAAAAAGACACCTCTGCAAAATGTGCCTCAAGTCCATT TCTTGGGATCGCTCGTTTGGTGCACTCTCGTGGGAGACAATCAGAGAACAACATATACTTGT GCCTTATTTTCA | SEQ ID NO: 1693 |
| LPP | ADXCRPD.9098.C1_at | GCATCCACAGTGAATGGGATCCCATCCAGGCTGCGGTGGCACATCACCGCAGGGTGAAACAG GTGAGGATGATTAGGCCTTCCCGGTGGCTCGGAGAATCCGCTCCATGATGGGCTTGGAACAC ACATTGCACTGCTCCAGAGTATTAATGTAGCAGGGCTCGCAGTATGCTTTCTTTTCCACAGC ATAAAATGGCTGCCCTCGGAGCTTGTTGTTGAGATGATGCANGTNAAACAATCCACGTGGAA GACCTGATCCATGGCAGTGCATTCTGTACCTTTCCCAACTA | SEQ ID NO: 1872 |
| LPP | ADXCRPDRC.9098.C1_s_at | AGGAGACTGTCCGTATTGTGGCTTTGGATCGAGATTTCCATGTTCACTGCTACCGATGCGAG GATTGCGGTGGTCTCCTGTCTGAAGGAGATAACCAAGGCTGCTACCCCTTGGATGGGCACAT CCTCTGCAAGACCTGCAACTCTGCCCGCATCAGGGTGTTGACCGCCAAGGCGAGCACTGACC TTTAGATTCAGTCACCTGTTCAGCCG | SEQ ID NO: 2040 |
| LPP | ADXCRSS.Hs#S1294625_at | TGAAGGTCTTCAGCAAAAATTTGGACTGTAAACACAGCTTGGCATTATCAGCATTCTGTTAA GTTCAAAGAAGAGATAGTTACAACAAATACAGCTTGCTTTATTTCTGAAACAAAACTGTGCA CATATTTGTGGCCATACTACTAATTAACCTGTAGATTGTTCCTTTCATCTATTCAGCGTGTT TTTCTGCCCCCTGTTACAACAGTGTTGGGTTACTTTTCCCATATGGACTATATTTAAACAGT TCCCTTATAGGCATTAGAG | SEQ ID NO: 2063 |
| LPP | ADXCRSS.Hs#S1908923_at | TGCCCTTTTTTGTGCCTGGGCTTCATCCTTGGAATGTTTTACCTCATGGGCCATGAGACGGC TGCCTGCTGAAACCCAAACTATAGATATCCCTGTTCCCATTTAGGGGAAAGAGCCTGGTTTG CTATATTCTCATAGGCTTGGCTGACTGTATATTTCTGAACCAGTCATTGAAGCCAAGAGAAT GGGATTATGGTAATATGAACCACTATTCTCCTGAAACTGAATTTGGACATAGTCCCATCCAA ACCTCATGGTACTTACACAGTGG | SEQ ID NO: 2119 |
| LPP | ADXCRSS.Hs#S1910599_at | GAAGACAACAACAGGTAAACGAGAAAATCCTTGGAAAAGAACACCGTTAATTTACAATAGTA TATGTCTCTCTGGCCAACGTACTTTGTTTCATGACACTACTGGCATCATCCATCCCAAAT ACTTTCGGTCGCTGTGTGTTTCAGACTCTGAAAAACCTTCAAATAACACAATAAAACCTGCT CCTCTTTTCCTTTAATCTTACATAAAGGCAGTTCTCTTAAGTCTATAGTCAAAGC | SEQ ID NO: 2123 |
| LPP | ADXCRSS.Hs#S1921588_at | GATTCAGTGGGCAACTGTGGCAATAGTTCTTGGCTAACCTGGTCACTATGGAAGTTCTTTCC GTGGAAAAAGATTCTCCATCCTTCAATTTGAGATAAGATTTACTAATTGAGACCTCATTTGT ATCTGATTTTAATCTTTGCATCATTTTAGTTTTAATAAACTAACTTTCCAACTTACCAGATT TTCGGGTTGACAAAGACCATTATTTAGAGAAACACAGGCAAAGGAAAGTCTAAAAGCTTTGG CTGGAATTTCAACTGCTTCTGGTCCAGAAT | SEQ ID NO: 2104 |
| LPP | ADXCRSS.Hs#S2732094_at | CAAAAATTCCTGCATATACCCACTCAGGAAATATTTTCCCAAATCTTCTCCATCTCAACTCT GTGAGGCATTGGAAGAGGTGCTTTTAGGCATAGACTGATGCACTCTATATATGATGTCTCGC CCTCCAGGGCAGCACACAGTTTAGTGAGGTAAATGTCTCATGAATATTCCACAAGATCCACC TTGATAATGCTCTAACGTTACTCATAGAGGGCTGAATGTGGAAAGATGCTTTCGTCTGGTGG CAAA | SEQ ID NO: 2109 |
| LPP | ADXCRSS.Hs#S2984275_at | GTAGCAGAAGCAGGACTGGAACCCAGAACCCAAGTTGGACCACTAGACTGGTGCCTCTCCCT AAGCCCACTCTGCCTCTTCCATGTCTGTGAATGAGCTTACCACTCCTAGCTATGCAAAACTG CATAGAACCATTTCAGCAAGAGGCTCAGGTAGCATTAAAGAAGTTCCCACCTCAACGATGTC AATTTTTTGTTACTGTTGTCTTGAGGAAGCATGTTTGCTTTTAAACGCTCCCAAATTAAAAG CCATTCTCAGCCTTCCTACAATTGTATG | SEQ ID NO: 2160 |
| LPP | ADXCRSS.Hs#S3748577_at | ATGGCAGTGAGCATTTATTCCGGGCTGAGTTTTACACTACCCATACTGTCTCTAACTCTCCC AACACTCCCACAAGGCAGGTGCTATTATCCCCATTTTACTTTTGAGAAAATTAAGGCCTAAA GAAGTGAGAAAGCTTGTCCAAACCGCTATAGCTCTTGGGCAAAGGCATTAGTGACCAATGTG TATTTGACTCCAAAGCCCAGGATGTTAGCCACAGTGCAGGGCTACTATCCTTTTATACAATC TGTCAGGCTTCTTCCATCCGTGGCATGTATTCATCTA | SEQ ID NO: 2197 |
| MAP4K4 | ADXCRAD_BG110060_at | GAAAGCGCGAAAACAACACAGAGAACACAACAAGAGGAGATGAGTGGGCGCGTCAGAATGAA AGCGGGGGCCACCACCACGCAACCACCATGAAAGAAGACGACGCAACAGAAAACAAAAAAG GAGGCCGACACCATAACGGAGGAGAACAGAAGAGAGGAGAAGACATCGATCGGGGAGAAAG AGACCACAGCAACAGACGGAACAAGGATGACGCACAACGGAGCAGAAGAA | SEQ ID NO: 2682 |
| MAP4K4 | ADXCRAD_BP228866_s_at | ATATCGAAGTCCTGGCTTTTCTCGTTTTCTCACTTGCTCTCTTGTTCTCTGTTTTTTTAAAC CAATTTTACTTTATGAATATATTCATGACATTTGTAA | SEQ ID NO: 2343 |
| MAP4K4 | ADXCRAD_BQ647365_at | GTAGAAGCAGTGTGATCCAGGGATTACTGGCCTCCAGAGTCTTCAAGATCCTGAGAACTTGG AATTCCTTGTAACTGGAGCTCGGAGCTGCACCGAGGGCAACCAGGACAGCTGTGTGTGCAGA CCTCATGTGTTGGGTTCTCTCCCCTCCTTCCTGTTCCTCTTATATACCAGTTTATCCCCATT CTTTTTTTTTTTCTTACTCCAAAATAAATCAAGGCTGCAATGCAGCTGGTGCTGTTCAGATT CT | SEQ ID NO: 2704 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| MAP4K4 | ADXCRAG_BC065036_s_at | TAGGTTTTCGTCTTAGTTGTAGCACACTTACCCTAATTTTGCCAATTATTAATTTGCTAAAT AGTAATACAAATGACAAACTGCATTAAATTTACTAATTATAAAAGCTGCAAAGCAGACTGGT GGCAAGTACACAGCCCTTTTT | SEQ ID NO: 975 |
| MAP4K4 | ADXCRPD.1395.C1_at | TTTCTTCTGCAAGTGCAGACTGTGGTAAAACTTTTGTTGCACGTCTAGGTTTAAACAAAAAT TAAACCTTTAACTGAGGCAGTGCTAATACTGTCACACGACAAAGTTCTGGCCATTATACAAA ATGCACACGNNNNNNNNNNNNNNNNNNNNNNNNNNNNNNNNNNNNNNNNNNNNNNNNNNNNA GAACCATCTGCACATGATTTAGGCAACCTGGTACACAGAAAAATGACTGAGTTCTTGGCCAG | SEQ ID NO: 1397 |
| MAP4K4 | ADXCRPD.17623.C1_s_at | AAGTTCCATTGTGAACGTGCCTGGTGAGTCTACTCTTCGCCGAGATTTCCTGAGACTGCAGC AGGAGAACAAGGAACGTTCCGAGGCTCTTCGGAGACAACAGTTACTACAGGAGCAACAGCTC CGGGAGCAGGAAGAATATAAAAGGCAACTGCTGGCAGAGAGACAGAAGCGGATTGAGCAGCA GAAAGAACAGAGGCGACGGCTAGAAGA | SEQ ID NO: 1402 |
| MAP4K4 | ADXCRPD.2985.C1_at | AGTAGGCGGCTTTGGCCTTCAGCACTGCTCCAAACTCATACAAATGAAACATCCATTTCCAT CTTCTTTTACTTCCCCAAAAAGTAAGCTTCTCAGCTTGTCTTTACAGGTATACACAAAACCA CCAGCTGCTGTGTCTGCATTCATGAGTGGATGTACTTGTCTTACCAGATGTTTGTAGCTCAA AGGAGGGCCTTTTTCAAAAAGATGGAACCAGGAACAGGAAACTGACAAGAGGTCAGAGTGGG TGCCAAGTGGGATGGGAAGCAAACAGGTACAAATGGCCGGACGCGT | SEQ ID NO: 1603 |
| MAP4K4 | ADXCRPDRC.1395.C1_s_at | AATGCAATGCACTAAAACTATTTTAAGAATGTAGTTAATTCTGCTTATTCATAAAGTGGGCA TCT | SEQ ID NO: 1923 |
| MAP4K4 | ADXCRPDRC.2985.C1_s_at | ATTTGTATGAGTTTGGAGCAGTGCTGAAGGCCAAAGCCGCCTACTGGTTTGTAGTTAACCTA GAGAAGGTTGAAAAATTAATCCTACCTTTAAAGGGATTTGAGGTAGGCTGGATTCCATCGCC ACAGGACTTTAGTTAGAATTAAATTCCTGCTTGTAATTTATATCCATGTTTAGGCTTTTCAT AAGATGAAACATGCCACAGTGAACACACTCGTGTA | SEQ ID NO: 1973 |
| MAP4K4 | ADXCRSS.Hs#S1921392_at | GACAAAAGCCTCTGAAGTAGGCATTATTCCATTTACAGATGAGGAAACTGAGCTTTATCAT GCTTAAAAGTATGTATTGCTGTCTTGGGGAAAAAGGCAGGATATGACTACTAAATAATGAGG TTAACTGCCTAGGAGGCTCATACACTATAAATTCACCTTGAAAATTATTTATGGGCCTCAAA TTTATGTTCCTGGGAAAGAGGAGCAAAAGATTAAATCATTTTTATTAGTTCAGTGACAATTC TAAAAATGAAACCCAGAAATGTACTCACTCCTAACCACTC | SEQ ID NO: 2101 |
| MAP4K4 | ADXCRSS.Hs#S1921392_x_at | GACAAAAGCCTCTGAAGTAGGCATTATTCCATTTTACAGATGAGGAAACTGAGCTTTATCAT GCTTAAAAGTATGTATTGCTGTCTTGGGGAAAAAGGCAGGATATGACTACTAAATAATGAGG TTAACTGCCTAGGAGGCTCATACACTATAAATTCACCTTGAAAATTATTTATGGGCCTCAAA TTTATGTTCCTGGGAAAGAGGAGCAAAAGATTAAATCATTTTTATTAGTTCAGTGACAATTC TAAAAATGAAACCCAGAAATGTACTCACTCCTAACCACTC | SEQ ID NO: 2102 |
| MAP4K4 | ADXCRSS.Hs#S2732925_at | TACCATGATCTCTTTGTGCTTCCTCATCTTTCATTGGCAAATCTCTGGAATGGGCCATATAA ATGCAGCCCTCAAATCCTTAACAGCTTATGATTCGGCTTCCATCACTCACATTTAAGCTTTT CTTAAAGATCACTTTCCACCATCATCAAGAAACAACTGTAGTCAGTTCTCTTGTCCTTCCAT TTCTTAGGACTATCAAAATATTGTGATTTGATATTTGACTCACCCTACTTCTCTAACCTTGT ACCGTCACAGT | SEQ ID NO: 2135 |
| MAP4K4 | ADXCRSS.Hs#S2984613_at | TTGTTATGGAGCAGGTTCAGTAATAAGAGTTGGTGAGTATTATTCAGAAGAGAAGCTGCCTC TTGGGTTGAGTAATTAATAAAGTGATTCATTGGGAGGTAGTTTTTTGTCTGTAAGAATTCT AAGGAATGATCACAATGATAAGTTTTAGGACATCCCGTTTTAAAAACTGGACTCTTACAAAC TTTGTTATCTAGATAGCATTAGGTATAACTAAATTGGGGAGACAAAAGTGAAAAACGATTAA CCATATAAGGGTGGTTTCA | SEQ ID NO: 2157 |
| MAP4K4 | ADXCRSS.Hs#S2984613_x_at | TTGTTATGGAGCAGGTTCAGTAATAAGAGTTGGTGAGTATTATTCAGAAGAGAAGCTGCCTC TTGGGTTGAGTAATTAATAAAGTGATTCATTGGGAGGTAGTTTTTTGTCTGTAAGAATTCT AAGGAATGATCACAATGATAAGTTTTAGGACATCCCGTTTTAAAAACTGGACTCTTACAAAC TTTGTTATCTAGATAGCATTAGGTATAACTAAATTGGGGAGACAAAAGTGAAAAACGATTAA CCATATAAGGGTGGTTTCACAATGGCACGTG | SEQ ID NO: 2158 |
| MAP7D1 | ADXCRAD_BU178034_x_at | GTAAATAGCTTGTGCTCAGACTCCTCTGCGTGGAGAAGGTGGGTGCANGAGGCAGACCCTCC CCCCAAAGCCCCTGGGGAGATCTTCCTCTCTATTTAACTGTAACTGAGGGGGATCCCC AGGTCTGGGGGATGGGGACAACCTTGGGGCCACAGGATCTGGGTTGCTTCAGGGGGTAC CCATGGCCCCCCTGCCCTCGGCCTGGGAATCAGTGGNTACTGGCATCTGAATTAAAATGTTC TTCCCCGA | SEQ ID NO: 2681 |
| MAP7D1 | ADXCRPD.6828.C1_s_at | TTGCCTTGATTTGGTGGGTACAGTGGATGTGAATACTGTAAATAGCTTGTGCTCAGACTCC TCTGCGTGGAGAGGGTGGGTGCAGGAGGCAGACCCTCCCCCCAAAGCCCCTGGGGAGATCT TCCTCTCTCTATTTAACTGTAACTGAGGG | SEQ ID NO: 871 |
| MAP7D1 | ADXCRSS.Hs#S1907164_at | GGCTTAATGTGATTTGCTCCATAACACTGTGCCAATGACATTTCATCAGGGTTGGCAAAATT GTGAAGAAAATATTTGTATTCAGGGTCAATAGTGTGCCGGGTCACAGAGGAGTTCCAAACT TCTTGTTTGCCTCTTGAGAAGTTTTTCTTGTTGAGCTGCTGGAGTAAACACTCATTATTATT TTTATTAACTTCTACCTGTGTGGCTTAGTCCAGGAAGCTGCCCAAACACTATTGAGATGGAG TTGTTTTGCTTCTCTTCAAATGTTTATCTTTT | SEQ ID NO: 2126 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| MARCKS | ADXCRAD_AV732105_at | GAATGTACTTTGCTTTACAAAATGCTATAACTCTGCTTAGGNGTCTATTTTCTTGAGCCACT AAAGCGAAAATAATGT | SEQ ID NO: 2375 |
| MARCKS | ADXCRAD_AV732105_s_at | ATTTTAAACTCAACCAAGCTGTGATAAGTGGAATGGTTACTGTTTATACTGTGGTATGTTTT TGATTACAGCAGATAATGCTTTCTTTTCCAGTCGTCTTTGAGAATAAAGGAAAAAAAATCTT CAGATGCAATGGTTNTGTGTAGCATCTTGGCTATCATGTTTTGGAAATACTGGAGAAGCTTT GACCAATT | SEQ ID NO: 2376 |
| MARCKS | ADXCRAD_BM557039_at | AAAATAGCTTTTGAGGATTAACGCAAAAATAAAATAACTCCTTGTACCAGGTCCAGAAATTG GCCTATTAAAACCTGAATTTGGGCAGTATTTTATAATGGGCCATTTGGCTTGTGGGTTACA AAA | SEQ ID NO: 2623 |
| MARCKS | ADXCRAD_CD103045_at | TGAGGGAGGTTTACAGCACTACAGGTCTTGAGTTAAGAAGGAAAGAGGAAAAAGAAAAAACC CCCATACCCGATTTAAAAAAAAAAAAAACCGATCCTTAGTCTTTAGAAGTTCCATTTAAAC CCATAGGGAACCTTTTCCCCTTAATCCTCATGGTTAAGCCTGTACCCAGTTCCAG | SEQ ID NO: 2612 |
| MARCKS | ADXCRAD_CD110028_at | CAACGGCAGCGTCCCGGCCCGCCGAACAAAGAGGAAGCCCGCGGGCCGCCGGGAAGCGGGG GCGGCCTTCACCCCTCCCTCGGGCCCGAAAAAAGGGTGAAGTCGGGTCCCGCCGAACCGCCA TGCCCTCCCTAAAGG | SEQ ID NO: 2374 |
| MARCKS | ADXCRIH.653.C1_s_at | AGTGAATAGTCAAAAATCCTGTTAGCAAACTGTTATATATTGCTAAGTTTGTTCTTTTAACA GCTGGAATTTATTAAGATGCATTATTTTGATTTTATTCACTGCCTAAAACACTTTGGGTGGT ATTGATGGAGTTGGTGGATTTTCCTCCAAGTGATTAAATGA | SEQ ID NO: 1112 |
| MARCKS | ADXCRIHRC.653.C1_at | TTTTTGATCCATTATTCCAATTAAGAATGCGTGTCAAAACCTAATTTGTTATTTTTCTAATG AGTTTAAGATTTGGCATTCAGTTGTTACACATGTGGTTCAATGATTTATCATGAACCCTAAA CTGCACACTGCTCAAAAACAGCAAAACAGATGTGCATTAAATGAAATAATGTTTTTGATACA TATCTTAAATTTCAATCAGTTTAGGGTCCTTTGAAGGAAAAGATATCCAGTTATCGGGTGGC AAAGAGCAGAGGAGGTAAACTCCTCGTGCCG | SEQ ID NO: 1305 |
| MARCKS | ADXCRPD.2741.C1_at | GGGTCTCCTCTCTCGGGCGGCTACTACTCCACACCGAGAGGGAGTGTCTTACAAGGCGGCCG GCGTGCAAACAAAAAAATAATATAACCGNNNNNNNNNNNNTCGGTCGCACCTATATTCGAGCA AAGAAAAGCGTGGGTGGTAAAGTATATTCTATAAACACAATTTCCTCGCGCCCACCACGGTG GAATACCCACTCCCCATAAAACGGCCGGTGGGAGAAGACTCTCGAACACCGCCCG | SEQ ID NO: 1908 |
| MARCKS | ADXCRPD.3926.C1_at | AATCCTCCCGTCTCTCCAAAACCATCTCCCCGTCCCCTGACATTGCGGCGCTCTGANNNNNN NNNNNNNNNNNNNNNNNNNNNNNNNNNNNNNNNNNNNNNNNNNNNNNNNNNNNNNNNNNNN NNNNNNNGAGAGAGCTTTTTGGCGCGCGCCTTTCCCCTGGCGCTTTTCTCCCCGGGAGGATT GTTCTCCACTTTTCGCCCGTCATAGCCTAAATCCG | SEQ ID NO: 1672 |
| MARCKS | ADXCRPD.4423.C1_at | TTCAACAAAGAAACTCAACAGATCCAAGAGGGGAAACAAAGAGCCTCGGGTTGGTGTAACGA CGGGGCGAGCAGCAGCAGCAGCAGCGGCCAACAGCGGCAGCCTACAGCACACCGGAGGAAGG GGGGTGGGGGTGGTGGAGAGGACAGAACAGAACCGATTAAATACACTCCGGATAAAAAAATT TTAGTCGAAGAGATCAAAAAGCAGCAGCACAGGAGGGAGGGAAAAAGGGTGGAAAAGTCGAG CACCAAAAAAGGAGCCCCAGT | SEQ ID NO: 1648 |
| MARCKS | ADXCRPD.4423.C1_x_at | CCCATGCTGGCTTCTTCAACAAAGAAACTCAACAGATCCAAGAGGGGAAACAAAGAGCCTCG GGTTGGTGTAACGACGGGGCGAGCAGCAGCAGCAGCGGCGGCCAACAGCGGCAGCCTACAGC ACACCGGAGGAAGGGGGTGGGGGTGGTGGAGAGGACAGAACAGAACCGATTAAATACACTC CGGATAAAAAAATTTTAGTCGAAGAGATCAAAAAGCAGCAGCACAGGAGGGAGGGAAAAAGG GTGGAAAAGTCGAGCACCAAAAAAGGAGCCCCAGT | SEQ ID NO: 1649 |
| MARCKS | ADXCRPD.8271.C1_at | CCGTCCTCGGCCTTGGGCGAAGAAGTCGAGGAGGCGGCCGACGCGGCCTCTCCCTCCGCGGC CGTGGGCGAGCCGGGCTCGGCAGCCTCGCCTTCCGCGGGGGCCTCCTTCTCTACCGGGCTGG CCCCGGCCTCGGGGCAGCGGCGGCTGCCGGCTCACCTTTCGCGGCCGCG | SEQ ID NO: 1829 |
| MARCKS | ADXCRPD.8271.C1_x_at | CCGCTCAGCTTGAAAGACTTCTTGAAGGAAAAGCGCTTCNNNNNNNNNNNCGGGGTCTCGTT GCTGGGCGAGGGCGTGGCCCCGTCCTCGGCCTTGGGCGAAGAAGTCGAGGAGGCGGCCGACG CGGCCTCTCCCTCCGCGGCCGTGGGCGAGCCGGGCTCGGCAGCCTCGCCTTCCGCGGGGGCC TCCTTCTCTACCGGGCTGGCCCCGGCCTCGGGGGCAGCGGCGGCTGCCGGCTCACCTTTCGC GGCCGCGAAAGGCGACGCCGCCCCGCTCCCGGCGGACGAGGGCTCCTCCTTG | SEQ ID NO: 1830 |
| MARCKS | ADXCRPDRC.4423.C1_s_at | CGTTACACCAACCCGAGGCTCTTTGTTTCCCCTCTTGGATCTGTTGAGTTTCTTTGTTGAAG AAGCCAGCATGGGTGCCCAGTTCTCCAAGACCGCAGCGAAGGGAGAAGCCGCCGCGGAGAGG CCTGGGGAGGCGGCTGTGGCCTCGTCGCCTTCCAAAGCGAACGGACAGGAGAATGGCCACGT GAAGGTAAACGGCGAC | SEQ ID NO: 1981 |
| MARCKS | ADXCRPDRC.8271.C1_s_at | GAAGGCGAGGCTGCCGAGCCCGGCTCGCCCACGGCCGCGGAGGGAGAGGCCGCGTCGGCCGC CTCCTCGACTTCTTCGCCCAAGGCCGAGGACGGGGCCACGCCCTCGCCCAGCAACGAGACCC CGNNNNNNNNNNNNGAAGCGCTTTTCCTTCAAGAAGTCTTTCAAGCTGAGCGGCTTCTCCTTC AAGAAGAACAAGAAGGAGGCTGGAGAAGGCGGTGAGGCTGAGGCGCCC | SEQ ID NO: 2032 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| MARCKS | RDCR156_A02_at | GAAGTGAAATAATCATGCCTGCCCTGGCTGCTTCTGTGAGTGGAAGATCATAATTGGAGTGC ATGAAAGACTTTGTAAACTGTTAAGTGCTCTATAAACGTTAGCATTTTACTCAATAAATTTT TATCACACATTCGATGGAATAAGGAAAGAGAATTGAAATAATACAGTTTTTCTTCATTGCCT TAGATTATAATTCAGATATAATACAGTTCATTACATTTCATAGTTGTGGCTATTTCAGTAAA T | SEQ ID NO: 1347 |
| MARCKS | RDCR156_A02_x_at | AGTGAAATAATCATGCCTGCCCTGGCTGCTTCTGTGAGTGGAAGATCATAATTGGAGTGCAT GAAAGACTTTGTAAACTGTTAAGTGCTCTATAAACGTTAGCATTTTACTCAATAAATTTTTA TCACACATTCGATGGAATAAGGAAAGAGAATTGAAATAATACAGTTTTTCTTCATTGCCTTA GATTATAATTCAGATATAATACAGTTCATTACATTTCATAGTTGTGGCTATTTCAGTAAAT | SEQ ID NO: 1348 |
| MSN | ADXCRAG_BC011827_s_at | AGAATGACAGACTAACTCCCAAGATAGGCTTCCCCTGGAGTGAAATCAGGAACATCTCTTTC AATGATAAGAAATTTGTCATCAAGCCCATTGACAAAAAGCCCCGGACTTCGTCTTCTATGC TCCCCGGCTGCGGATTAACAAGCGGATCTTGGCCTTGTGCATGGGGAACCATGAACTATACA TGCGCCGTCGCAAGCCTGATACCATTGAGGTGCAGCAGATGAAGGCACAGGCCCGGGAGGAG AAGCACCAGAAGCAGATGGAGCGTGCTA | SEQ ID NO: 933 |
| MSN | ADXCRAG_M69066_s_at | CTGACCTTGAGGAGTCTTGTGTGCATTGCTGTGAATTAGCTCACTTGGTGATATGTCCTATA TTGGCTAAATTGAAACCTGGAATTGTGGGGCAATCTATTAATAGCTGCCTTAAAGTCAGTAA CTTACCCTTAGGGAGGCTGGGGGAAAAGGGTTAGATTTTGTATTCAGGGGTTTTTTGTGTACT TTTTGGGTTTTTAAAAAATTGTTTTTGGAGGGGTTTATGCTCAATCCATGT | SEQ ID NO: 998 |
| MSN | ADXCRPD.2854.C1_x_at | GTACTTTTCCACTTTGGATTTTGCAAATGCCCCCTAACCCTTTACTGGTTGTCCCTATGGGG AATCCAAGTGG | SEQ ID NO: 1582 |
| MXRA7 | ADXCRAD_BX099460_at | TGATCACCCCACTGGCAGGACAATTCACAGTTCTTGAGCAAACTGAGTTAGGGAGGGTATGC TAACGACAGAACCTATGCAAGTTCTTAGAAATATTTTTTGTTTGCTGAAATAAAGCTCAATC AACACACTACCTTAAAAAAAAGTGGGAGCAGTGGCATTTCCATGCCTCATGCTCACCATCAT GAGGTTAACTTCCCGCCGTCGCCTCTTGCCTGCCAGGGGTTTTTCGGGAGCCCCTCTCTGTT CCACTCTGATTCCTTTTGNTTCTTTGCTGACCATTCACTCTCTG | SEQ ID NO: 2442 |
| MXRA7 | ADXCRIH.2503.C1_at | ATGGCAACAGCCACACAGTCATTGCCTTCAACACAGAGCCACGTGTCCCCAAACAGCAATAG TCATGCCCTTGTCCAGGCTGGGATCTAATTGATACAATAGGTCGTTGACTCCCTCCTAGTAG AGCTATCTAGGTTTGTCTGGAAAGTTTCCGACCCTGGCTTATAGGCACCACACCTCATGTAC TCCTCATGGCTTGGATCTCTGTATTCAGCCTTTGTTCAGTCC | SEQ ID NO: 1205 |
| MXRA7 | ADXCRPD.17734.C1_at | AAAGGCCTCTAACCTGCTGGAAGATAGGGACCAAGTTGAGTATTTTATTTCTTCGTCTACA GCATCCAGCATAGTTCTAATTAAATACAATTAGGCAAGTACTCAAATAAGTCTTGCCTAATT ATATTTAAAGTAAGTATCCTGCTTAAGTGAGAGAAATTCTTGGCAGATCTTACCTCTAGTAC TATTGTTTAGTGCCAGGATGGAAGGTGAGTCTCTGAATTAGACTTTTTGCTGAAAGAACGCT CCCAGCTGGGCATGCT | SEQ ID NO: 1422 |
| NR2F2 | ADXCRAD_CB217549_s_at | ATTATAATTGTTGATATTTTCCCTTTTTAAAAAATACCATTGAAATCAGCATGACAAAAATA ACACTGTTGGCACTTATAGGTAACGTGATTGATTCAGTATCTTAGAGTTTACAGTTTGTGTT TTAAAAAAACTGAAGGTTTTTTTTTAAGTGCAACATTTCTGTATACTGTAAAAGTTATAATA ACTGAACTGTTTGGTCGAGTCTTTGTGTGTTA | SEQ ID NO: 979 |
| NR2F2 | ADXCRAD_CB956496_at | GCGAGCGAGATCTTTGGAGAGATTTTTTTTTTGCCTCCTACTTCTGTCTTGAAGCCAGACA ATCGACTTCAGCTCTCCCTCCCCTCCCTCTTTCTCCACGTTCTGCTCCCACTCGCTCTCCTG TCCCCTTCCCCTCCCCTCCCGGCGAAAGCCCCCGAAACCAACAAAGCTGAGCCGAGAGAA ACAAACAAAACAAACACACCGGGCCAGACAAGCCATCGACAAAACTTTGCAAAGTCAACC | SEQ ID NO: 2487 |
| NR2F2 | ADXCRAD_CB956496_x_at | GCGAGCGAGATCTTTGGAGAGATTTTTTTTTTGCCTCCTACTTCTGTCTTGAAGCCAGACA ATCGACTTCAGCTCTCCCTCCCCTCCCTCTTTCTCCACGTTCTGCTCCCACTCGCTCTCCTG TCCCCTTCCCCTCCCCTCCCGGCGAAAGCCCCCGAAACCAACAAAGCTGAGCCGAGAGAA ACAAACAAAACAAACACACCGGGCCAGACAAGCCATCGACAAAACTTTGCAAAGTC | SEQ ID NO: 2488 |
| NR2F2 | ADXCRPD.4673.C1_at | GAATTGCCATATACGGCCAGTTAAAACTGCTGCCGGACAGTAACATATCCCGGATGAGGGTT TCGATGGGGTTTTACCTACCAAACGGACGAAAAACAATTGCTCTATGACTGAGGAGGAGAC GGTGCGGAGGGAAGGGAGGCGAAGCAAAAGCTTTCCGAATCTCGTCGGCTGGTTGGGGTACT GGCTCCTAACGTATTCTTCCAAAGCACACTGAGACTTTTCCTGCAAGCTTTCCACATGGGCT ACATCAGAGAGACCACAGGCATCTGGAAGA | SEQ ID NO: 1691 |
| NR2F2 | ADXCRPDRC.4673.C1_s_at | ATCCGGGATATGTTACTGTCCGGCAGCAGTTTTAACTGGCCGTATATGGCAATTCAATAA | SEQ ID NO: 2001 |
| NR3C1 | ADXCRAD_AI934556_at | GATGAATGTGCGCTTTGGAAATGTTTAAATAGATATGAAATGATTAAATAAAATCACAGTCT TGTGCAACATCCATAGCTTACAGTTATTTGGCAACTATGAAACCACAGTTACTAATGGAATT AAGACTTTNTAAAAAATTGCAAATGTACTTATTTGTATATGAAAGAGGTATTCAGCTATTAA CTCAGTATTTAATAAACATTGATATGTAATTTTTACTTGAAATGGCCTAAGGTTTATAATAC CAACTAGTTCATAGAGCTTTTTT | SEQ ID NO: 2815 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| NR3C1 | ADXCRAD_BQ433598_at | GGTTACTTTCACATACAGCCCTCCCCCAGCAGTTGAATGACAACAGAAGCTTCAGAAGTTTG GCAATAGTTTGCATAGAGGTACCAGCAATATGTAAATAGTGCAGAATCTCATAGGTTGCCAA TAATACACTAATTCCTTTCTATCCTACAACAAGAGTTTATTTCCAAATAAAATGAGGACATG TTTTTGTTTTCTTTGAATGGGCTTTTGAATGTTATTTGTTATTTTCAGAATTTTGGAGAAAT TATTTAATAAAAAAACAATCATTTGGCTTTTTGAATGCTC | SEQ ID NO: 2380 |
| NR3C1 | ADXCRAD_CA392568_at | GTGCCTTTTATAGCTATTACTGTCTGGTTTTAACAATTTCCTTTATATTTAGTGAACTACGC TTGCTCATTTTTTCTTACATAATTTTTTATTCAAGTTATTGTACAGCTGTTTAAGATGGGCA GCTAGTTCGTAGCTTTCCCAAATAAACTCTAAACATTAATCAATCATCTGTGTGAAAATGGG TTGGTGCTTCTAACCTGATGGCACTTAGCTATCAGAAGACCACAAAAATTGACTCAAATCTC CAGTATTCTTG | SEQ ID NO: 2379 |
| NR3C1 | ADXCRAG_X03348_s_at | AAAGTGTCTTTTTACCTACGCAGTGAAATGTCAGACTGTAAAACCTTGTGTGGAAATGTTTA ACTTTTATTTTTCATTTAAATTTGCTGTTCTGGTATTACCAAACCACACATTTGTACCGAA TTGGCAGTAAATGTTAGCCATTTACAGCAATGCCAAATATGGAG | SEQ ID NO: 1078 |
| NR3C1 | ADXCRSS.Hs#S1907985_at | GGGACTAATGTAGCCTTGCTTCTGAGATGTGGCCCCTAGGTCTCTACTGAATGCCCGGCATA TTTAATTAGATCTTTCTTTCCTCTATGGCCTCAAGGGATTTCACCCTAAGTATGCACAAATT TTTATTCAGCCGAAGACTGTACAGATTTCTGGAGGCCTTTCTTTGTGTACCTCCTTCGTTTC CAGTAGTCTGACCCATAAATTGTACAGATTTCTG | SEQ ID NO: 2121 |
| NR3C1 | ADXCRSS.Hs#S821188_at | AATGAGCAAGCGTAGTTCACTAAATATAAAGGAGTTTGTTAAAACCAGACAGTAATAGCTAT AAAAGGCACAACTTCCCTTTTCTGATATACACTTGTAAACTTTTTTCAGGTTTCCATGCAT AAATCAAAAATGCTATCCTAACTATACAGGGGGGGGATACACCAACAGAAAGTCTAGAAAAT TTCATCCAGCCAACTGTGTAAAAAAGTATGAAGAGAAAGTTCCTCACACAGACTTTGGGCAC TGGTGGTTTAGGTGGCATCCATCTTTGACTGT | SEQ ID NO: 2224 |
| NT5E | ADXCRAD_BC015940_at | TTCTTTACACAGGTAATTGTTTCAAAAGGATTGCATGGGCCAGGATGTCCAGATAAGCACTG TGTCTCTTTTGCCTTTGTAACTGTTATTACTCTTTTTACTGCTATTTAATATGTAATGTATA TTATATGATCTATAATATATATGTAATATACATTAAATGGGAACATGTGCAAATCTTACAAA A | SEQ ID NO: 2778 |
| NT5E | ADXCRAD_BG611920_at | TAAAAATTGGACAGATTAGCCCAAAAAAAGACACAATCACAACAAACAAAACAAAACTATT GTTGGCGGCACTGTGCGCCCCAAAGAAACTCTGTAAAACACCTAGCGGTTAGGCACAGCGGC CCCATAGGAAAGCGAACATGTGCAAACATGTCCCCAGAAAAACCCGGAACAAAAAAACGGCG CGGAAACGCACCCAAAAAACACGCCCGGGGAACCGCGGTTTTGGACAAACCAGAGACATCAC AACAAAA | SEQ ID NO: 2714 |
| NT5E | ADXCRAD_BM704188_at | GGAGAAAGCTCCCTCCGTTCTGATGCTTTTGAGCTTATCAGGGACACCCTGCAGCAGAAATT CCAGCTGATCCTTCAGCCTTCAGAGTTGATGAGGTGGGGCTCACACACATCTGGATTTGAAG AAGAATCGTGGGTTTCAAGAACTCTGTGGTCTCTTAAGCATTGGTATTCCACAGCTACACTT CCCTGATACTTTGCACTCAGTAATGACAA | SEQ ID NO: 2446 |
| NT5E | ADXCRAD_BX404438_s_at | TTGTGGGAATCGTTGGATACACTTCCAAAGAAACCCCTTTTCTCTCAAATCCAGGGACAAAT TTAKTGTTTGAAGATGAAATCACTGCATTACAACCTGAAGTAGATAAGTTAAAAACTCTAAA TGTGAACAAAATTATTGCACTGGGACATTCGGGTTTTGAAATGGATAAACTCATCGCTCAGA AAGTGAGGGGTGTGGACGTCGTGGTGGGAGGACACTCCAACACATTTCTTT | SEQ ID NO: 2316 |
| NT5E | ADXCRAG_NM_002526_at | CTTTGAACCACTTTGCAATTGTAGATTCCCAACAATAAAATTGAAGA | SEQ ID NO: 1015 |
| NT5E | ADXCRAG_NM_002526_s_at | GCAGCAAAATAATAGCCTCGGTTCTATGCATATATGGATTGCTATAAAAAATGTCAATAAGA TTGTACAAGGAAAATTAGAGAAAGTCACATTTAGGGTTTATTTTTTACATTGGCCAGTAAA ATAGGGTAAATCCTATTAGAAATTTTTTAAAGAACTTTTTTTAAGTTTCCTAAATCTGTGTG TGTATTGTGAAGTGGTATAAGAAATGACTTTGAACCACT | SEQ ID NO: 1016 |
| NT5E | ADXCRPD.5241.C1_at | CACACAGAGTTCTTGAAACCCACGATTCTTCTTCAAATCCAGATGTGTGTGAGCCCCACCTCAT CAACTCTGAAGGCTGAAGGATCAGCTGGAATTTCTGCTGCAGGGTGTCCCTGATAAGCTCAA AAGCATCAGAACGGAGGGAGCTTTCTCCCCTTCTCTCATCTCATTAAAATGAGCTTTCTTGT TGTGGGGGTTGGGAGGGACCTTTAAAACCAAACAATGGTGCCCTCTTATCATCTTTTTCT GTCCTCCTTTCTCCAAGTTTCCAGAGGG | SEQ ID NO: 1683 |
| NT5E | ADXCRSS.Hs#S1299958_at | ATTGAACAGAGAATCTACCCCAAAGCTGTGAGCTTAATTACTCTCAAGCTCCGGGGTCAAAG AGATCTGGTGTCCATTCTTATCACGTCTCCCTTTTTGCGGGGATGGTGCCTGTTAATTTATT CAGCTTCTTCGACGCGGTTTCCCTTTCAATAAGATTGAGATAAAGCATTTTTCGAAAGATCT AGATTGAGATAAAGCATTCTTTGAAAGATCTAGCAGTAAA | SEQ ID NO: 2064 |
| NT5E | ADXCRSS.Hs#S3735513_at | TTCCCTCTGGCAAGGAAAGACTCAGATAAAATTCCCCATGACTTCTAAAGGTGCTCCTGGGC ATTACTTTTCATTGTTTTTCCTGGGGATGCTGTTTCCTCAGAATGTCGTTGTATTATAGTAC ATTCCTTAAGGGATATGGTTTTCATTTTCCTGAATGTTGCTCCTTTCTCTCATTTTACCAGC AACTTGTTACTCCCTTTCACTTTCAGACTCTTTTCTCTCTTTCCCTTCTCCTTCAGCAACTT CTCTCCCCATTGAAGTTAGAAGT | SEQ ID NO: 2207 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| OSBPL3 | ADXCRAD_CN419328_s_at | GGAAATCCGACGATGACTCTTGGGTGAGCAACGGCACCTATTTGGAACTTAGAAAAGATCTT GGTTTTTCCAAACTGGACCATCCTGTCTTTATGGTGAAAAAGTAAAGAAGAAAGATAACATTA GTGTATTTCTCCTGTGCTTGCCTTCTGAAGTGGCACAAACCTGTGTTTATATATTTAAAAGA TACTCTAGGATGATCACTTGTGCTTAGCTTAACATTGTAACTCTTTAAGTCTATATTTTCCT CAGTGCGTTTCTTTACAATTTCAAATGTTACCCTGA | SEQ ID NO: 2741 |
| OSBPL3 | ADXCRAG_AF392444_s_at | TCTGTGTTGGAAACCTGCGTCATGTAAATATCTGCAAATCATGACAGTCTAAAGTGCAAACC ATTTTCAGAGACTTTGGGGAATGCAGTGATCAGAAGTGGCTAATTTATTTTATTTCTGATTA TTTTTATCCAGAGGGTACTTTTTTAATGGATATTTGTAAATCTTCCACTTAACCACTGAAAT TATTTTGTTTTAATCCCACCCTTCCATCCATACCTCTGCCTCCCCAAAAAGCTCCTATTAAT TTGCTTATCCCCCTCATGTAGCTAGTTGAATGTG | SEQ ID NO: 877 |
| OSBPL3 | ADXCRPD.12932.C1_at | GATTCCATTAATACAAAGTCCTAGAACAGGTAAAACCAGATGGTAGTGATAGAAATCAGAGG CATCAGGGTTAGAGTTGACTGCAAAAGGGCATGAGGGAGCTCTTTGGGTGAGGGAATGTTCT TGAGGTGATGATTGAAGCGATGGTTACATAGGCATATACATGTGCTCCAAACTCATCAGTC TGTACAT | SEQ ID NO: 1670 |
| OSBPL3 | ADXCRPD.2801.C1_at | TGCTTCCTTTTCAAGAAGGTGCCGTATACGTCTTATATAAAAATATACATTCCATTAATCTT ATATCCACTCCCTAACCACTAAAATGCAATGAAAATATTCTTCAGACTCCAGCACCAGCAG AATTGTTCTGTATGAGCAATTCAAGAGCTGTCTGAGGCAAAAAGATATTTCAGCTACCAAAT TAAACTTGGGTAGCTTACGCATGGGTGAGTAACCCTGGGAATTCT | SEQ ID NO: 1579 |
| OSBPL3 | ADXCRPD.2979.C1_at | ATAGTATTGCTCGTAGCCTTTCGGCATAGGATTTGCTCTCCATACACAGGCAGAAGAGGAGC CGCCGCCACAGTAGATGCTTTCATGCCATTTCCCAAACAGCCGATGAACCGCTTTTCCACTC CTGTCAAACACTGTGCCTTCAATCTCATGGGCATTAGTGCTCCAGTATTTTGCCTTTATAAA ATTCACTTTCA | SEQ ID NO: 1602 |
| OSBPL3 | ADXCRPDRC.2801.C1_at | TTGAGATACTTTAAAGAATTCCAGAGCATATC | SEQ ID NO: 1968 |
| OSBPL3 | ADXCRPDRC.2801.C1_s_at | ATATGTGTAGTAGTTGAATTGTGTTATCAAAGCATGTCCAACTTCTGTCCAGATGACATTAA AACCAAAGCCTAATTGTTAAGCCTCTTATTCTAAAGTCCATAGCAATGCTATGGAATATCAA GTATAATGATGTAGTAAAAAGATTTCTCCAGA | SEQ ID NO: 1969 |
| OSBPL3 | ADXCRPDRC.2979.C1_s_at | GAAAAGCGGTTCATCGGCTGTTTGGGAAATGGCATGAAAGCATCTACTGTGGCGGCGGCTCC TCTTCTGCCTGTGTATGGAGAGCAAATCCTATGCCGAAAGGCTACGAGCAATACTATAGCTT CACACAGTTTGCGCTGGAATTAAATGAAATGGATCCATCATCAAAGTCTTTATTGCCACCTA CTGACACTCGATTTAGGCCAGACCAG | SEQ ID NO: 1972 |
| OXSR1 | ADXCRAG_BC008726_s_at | GTAATATGTGCCAATGCTATTTGTGAAATGTTTGGTCTTTCTAAACGACTAAAGGATTGTT GGGTTTTTGCTTAAGTTTTGAACCAAATCCTAGAGCCAGCTGATAATATTTAATAATCTAGA GGAGAGAATAATGATGTACCAATAAGTGGAGATTCCTCCTTATGATGTATGCTAGGTTATGG AAGATGTAAAATATTCAACTTTTTCCTCCTTTTTTTGGACTTTGTATTTTACTGCATGTTT | SEQ ID NO: 925 |
| OXSR1 | ADXCRPD.10116.C1_at | TGAGATGATCAGACACCGGAGTTCAACGTCCCAGCAGTCTTGGTAAAAGGAGGGAGCCTACT GAGCCAGGAGGGAGAAAAGAAGATTGACCAGCTTGCTAGAAAAATACTTAGCNNNNNNNNNN NNNNNNNNGTGGAGGGGGGACGGAGAGGAACAAGGATGGGAGGTAGGAATGAGGTATAGAA AAGAGATAGCATCTTCTTTGGCACAAGACTAGTGGCT | SEQ ID NO: 1859 |
| PCMT1 | ADXCRIH.1058.C2_s_at | GTTGTAGATACAATCAGCTGCTTTGTTACCTTAAAACTAGGCATTTGTAAATATTAAACCAT AAGATGGCAGGTGATGTCCTGTAAACACTCAGCTGTTCAGATTGGACATAACTGACTTAGTT CTTCCCTTCTCTCTCTCTCAAAATTATAGGAGACTTGTAGTTTAGTGTGGTTTTCTGTTTCT AATTTGCTGCTGATAATGTATATGAACTTAACATGCTGTGTAAGCTGTGTCCTAGTTCTTGA ACAGTTTATGCAGTGCTGCTTTGCCAAATAAAGTT | SEQ ID NO: 1291 |
| PEA15 | ADXCRAD_CN347927_at | TGAACTGTCCTTCCATTTGGGATATGTTACATTAGAGTGAGAGAGAGAATAAGGAGCCTTTC TTATGGAAGAAATGGGAGAAGAGAGACAGGGTTCTTTTCAGCAGAGTCTAGTAGTTTCTCTG TAAGGCAAAATAATCTAAAAAGACTAACCTGCCCACCCACTCCTTATATTGCTGTGAGATTG CCCCTATCTTGTGCTCTTCTGTCTGCAGTGTGCACGGCCTTGTTCTAACCC | SEQ ID NO: 2608 |
| PEA15 | ADXCRAD_CX867144_s_at | GTGTTTTCCTTTGCACCGATCCCCACCCCAATTCAATCCCGGAAGGGACTTACTTAGGAAAC CCTTCTTTACTAGATATCCTGGCCCCCTGGGCTTGTGAACACCTCCTAGCCACATCACTACA GTACAGTGAGTGACCCCAGCCTCCTGCCTACCCCAAGATGCCCCTCCCCACCCTGACCGTGC TAACTGTGTGTACATATATATTCTACATATATGTATATTAAAACTGCACTGCCATGTCTGCC CTTT | SEQ ID NO: 1154 |
| PEA15 | ADXCRPD.14289.C1_at | AAATCAGCACATTCCTCCTACTTCCCTTTCCTCCACTCCCCCATATCTTTAAAGTGTGGAA GCAGAAAGGACCTGCATTTTCCTACATTGAGGAGCTGACATAGGGGTAAGGTATGGGAGAGG TAGGTGGATCCAGGGAAAA | SEQ ID NO: 1684 |
| PEA15 | ADXCRPD.14289.C1_s_at | AAAAGCCAGAGTTCCATGTTTGTACTCCTTGTGCTGGACTGTTTCCTGAGTACCAGCAGGTC CCTTTTTGTCTC | SEQ ID NO: 1685 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|------|----------------|----------------|-----------|
| PEA15 | ADXCRPD.14289.C1_x_at | AAATCAGCACATTCCTCCTACTTCCCTTTCCTCCACTCCCCCCATATCTTTAAAGTGTGGAA GCAGAAAGGACCTGCATTTTCCTACATTGAGGAGCTGACATAGGGGTAAGGTATGGGAGAGG TAGGTGGATCCAGGGAAAAGCAGTGGGGACGGAAGGCAAGAGACCACTCAACCCCCACCTGG AAGGGGCAAAGAAAAGCCAGAGTTCCATGTTTGTACTCCTTGTGCTGGACTGTTTCCTGAGT ACCAGCAGGTCCCTTTTTGT | SEQ ID NO: 1686 |
| PMP22 | ADXCRPD.5015.C1_s_at | AAATCATAAAGCCTTCATCACTCCCACATTTTTCTTACGGTCGGAGCATCAGAACAAGCGTC TAGACTCCTTGGGACCGTGAGTTCCTAGAGCTTGGCTGGGTCTAGGCTGTTCTGTGCCTCCA AGGACTGTCTGGCAATGACTTGTATTGGCCACCAACTGTAGATGTATATATGGTGCCCTTCT GATGCTAAGACTCCAGACCTTTTGT | SEQ ID NO: 1634 |
| PPAP2B | ADXCRAD_CD678016_s_at | TAAACTGTGTCTCGACCTGTGTTATTTACATTAGCTGCTTAAAAAAGCATTGAGTTAATTTT TTTAAATATCAACTAAAATATCATAGTTCTGTGGTAGACATTGTTTTATAATGAAATAACTG CAACTAGAGAAAACTGTATAAAAACATTAAATTGTCAGTATTTTTGTAAGGTTCCATTTTGT AAAGAGAATAATATTCAAAGACTTTTGTAGCATACAAAGTGAAAACTTGTATCTGCGAAACT ATACTTGTATTAAATGTGCTTTT | SEQ ID NO: 1024 |
| PPAP2B | ADXCRAG_AF480883_at | GCTCGTAACACAACTCTCATCTCAGGCTCTTCTAAAGAGCTTTTGTATTCTAAAGAGGATTT TTCCATCAGAGAGGTAGGAGCTGTAGGAACCCCGAGGGCAGATAAGCAGCCCTCACTCTAGA TAAGGTATGCTGGGGGAGCTTACTGAGGGAATCCTGTACACAGCCCACATCAAAGGAAGGCT GAGAATGGCCTGTGGCTCC | SEQ ID NO: 878 |
| PPAP2B | ADXCRPD.13412.C1_s_at | ATGTTCTGGCAGGATTTGCTCAAGGAGCCCTGGTGGCCTGCTGCATAGTTTTCTTCGTGTCT GACCTCTTCAAGACTAAGACGACGCTCTCCCTGCCTGCCCCTGCTATCCGGAAGGAAATCCT TTCACCTGTGGACATTATTGACAGGAACAATCACCACAACATGATGTAGGTGCCACCCACCT CCTGAGCTGTTTTTGTAAAATGACTGCTGACAGCAAGTTCTTGCTGCTCTCCAATCTCATCA GACAGTA | SEQ ID NO: 1641 |
| PPAP2B | ADXCRSS.Hs#S524340_at | TGACTGATAGCTGCCGCTTATGGTTACTTAGTAAAAACTCCTGTTGCTAAATGGCTCAAATG GATGTCTGTGTGTTTATTTTGCCATCTAATACAAAGCATAAATTTTTCTTACTCCAGTAGCT CATCAAACCCTTGAATCTTTCATCATAAGCACATTGAGGCAGGAACTATGCCTGTGCCATCC TCACACCCTTTGCAAGTGGCACTCAATAAATGTTTCTCAAGTATTGTTCAGACTCAGTGAGGG TCACATCCCCAGGAGGAA | SEQ ID NO: 2129 |
| PRNP | ADXCRAD_CX762421_at | ATAACATTGGTTATCTGGACTATTTTGGACTAGTGCACAGGTGAGCTAAACAATCTAGACAT CTGAATACTTGCTGGATCTCTGCTCTCACACTAAGTCATACTATGCTACTATAAATCAACTA TAAGAATCATTAGAACGAACTCGCAG | SEQ ID NO: 2673 |
| PRNP | ADXCRAD_CX762421_s_at | CTCTTTGTCCCGGATAGGCTAATCAATACCCTTGGCACTGATGGGCACTGGAAAACATAGAG TAGACCTGAGATGCTGGTCAAGCCCCCTTTGATTGAGTTCATCATGAGCCGTTGCTAATGCC AGGCCAGTAAAAGTATAACA | SEQ ID NO: 2674 |
| PRNP | ADXCRIH.1264.C1_s_at | CATAGGACAGACTTAGGAGTTTTGTTTAGAGCAGTTAACATCTGAAGTGTCTAATGCATTAA CTTTTGTAAGGTACTGAATACTTAATATGTGGGAAACCCTTTTGCGTGGTCCTTAGGCTTAC AATGTGCACTGAATCGTTTCATGTAAGAATCCAAAGTGGACACCATTAACAGGTCTTTGAAA TATGCATGTACTTTATATTTTCTATATTTGTAACTTTGCATGTTCTTGTTTTG | SEQ ID NO: 1241 |
| PSMD2 | ADXCRAD_CF130280_s_at | ACAGGGTTCCAGACGCATACAACCCCAGTGTTGTTGGCCCACGGGGAACGGGCAGAATTGGC CACTGAGGAGTTTCTTCCTGTTACCCCATTCTGGAAGGTTTTGTTATCCTTCGGAAGAACC CCAATTATGATCTCTAAGTGACCACCAGGGGCTCTGAACTGTAGCTGATGTTATCAGCAGGC CATGCATCCTGCTGCCAAGGGTGGACACGGCTGCAGACTTCTGGGGGAATTGTCGCCTCCTG CTCTTTTGTTACTGAGTGAGA | SEQ ID NO: 1018 |
| PTPLA | ADXCRAD_CD299090_at | ATCTCTGCAAAACAAGTGCTTTTTCCAGAATAACCAAGATTTACTGAGTCCAAGTTTTTAAT AACAAGAAATAAACAACCTTTGTGAAAATAATCATGGGATTGGTATGGGTTTT | SEQ ID NO: 2585 |
| PTPLA | ADXCRAD_CD299090_s_at | ATTATTTTCTTCTTATAACCATGGCATCATATATACCTTTGTTTCCACAACTCTATTTTCAT ATGTTACGTCAAAGAAGAAAG | SEQ ID NO: 2586 |
| PTPRK | ADXCRAD_AU145587_at | TGCTGGGCTGTTCTCTACCGAATACCATAAAACTGAATATTGTTCACCACTATGGTCGATCT TTCTAACTTTAAAGAGTACACAACTGAACTCAATTACTCCAAAGATATGTGAAAACACAGAA AAATGACCCCTGTTAAAAGAGTAAACCTAGCTTTTGNTTTACTTTCCTTTTATATAAAAAAA GATGTACAGGGTTCTCTTCT | SEQ ID NO: 2864 |
| PTPRK | ADXCRAG_Z70660_at | TATTGAGCCAGCAGCTGTTGTACCTGTTACACTTGTGCAGAAAGATTTTAATGTGGGGGGTG GGAGACTTTTACATTTGAGAGGTAAAAGTATTTTTTTTATGAAGTTGTGTATCTTAATAAAA AGAACTGAATTAGTTTTTATTACTATATTAAAGCATCAACATTTCATGCCACATAAATTAT ATTTAATAAGAACCAGATTGAAATGAGAACGTATTGGTGTTTGTACAGTGAACATGCCACCT TTTTCCATGGTTTCAGGTAGTGCAGCTACCACATGTT | SEQ ID NO: 1097 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| PTPRK | ADXCRIH.91.C1_at | TATAATGTGCTTTCTCCATATAGACATATTTACACTTGAGTCTTTGGCTTATGTTATTTTCT AAAAAGAACTTTAAATGATCCAGCCATCATTGCACATTAAAAGAAAATAAGCCAGTTATATA TATTTATATATTCCCATAGAGATCTGCTACACTGGAAACATATAAAAAACGAACTTTACTAT GAATTTGCACAGCTTTTCTTTTCTTCTTCCTTTTAAGATTCATCAGCTTTCATTTTAGAAAG GGAGCCTCGTGC | SEQ ID NO: 1182 |
| PTPRK | ADXCRIHRC.91.C1_s_at | CAATGCCAGATTCCTGTTTTGCGCATTGTCATGGGATTCTTAAGTGAACCTTTCTAAATGTG GTCTTGTTCACATGCTCCACGTAGCTGTAACTTCACATCATCAGCTTGCAGTTTGTAATTGA CTAAAGCATTCCAGTGTCCTCTTTCTAGATTGCCAGCTCATGACATGGTGCTTATAAAGA | SEQ ID NO: 1318 |
| PTPRK | ADXCRPD.10919.C1_at | CATAATAGTTCCAAGCTAAAAACAACCCAAATGCTCGTCAGCAGTGCAATGTATAAATAAT GGTGGCATATTCATAAAGTGAAATATTGTACTGCAAATAAATGAAAGAACCATTGCTTTATA CAATAACATGAATGAATTTCGCAAACACAATCTTAAGGGAGAGAAACCAGATGCAAGAGAGT ATGTATATATACATTTATATAAATTATGTAAGTTTCAGAAACAGGCAAAACTAATCAATGAT ATTAGAAATCAGCATATTATTTACTTGAAGAGGATTTGGGCAACTT | SEQ ID NO: 1525 |
| PTPRK | ADXCRPD.11104.C1_at | GGCAGTGGATAATCGTCCGGCCTTCCCCTTCCTCGCATTCCTCCTGCCACTTTTCCACCTGA AGTATCAGTTTCAAGAATGACCTTTTGGAACCAGGCACTTCTCGATGAGAAGCCCATCCTAG GTACTGAAACTGTTGCACCATCAGATAACCTTCCTGTGGTCTTGTTAGATTGCATATCCTAA AAATCCGGTTGATCACATCACAGTCCATTGAACAAGACATACATTCCACTTGGATGGGGCCA TATCGTAGCATCCCTTCCTCTGGCCAGTACTGAGGGCAGCCCTG | SEQ ID NO: 1425 |
| PTPRK | ADXCRPD.13194.C1_at | ATCACATGAATATATCTGCCTGACAAAAATTTGGGAAGTCCAGCATCTCTGATTTAAAAGA AGAAACTATTTGTAATTTTAGTCTCTTGTTCTTAATGCAGGATCTGACCATTGGTTAGTAAT GCAACAGCTGCGATTAGCAATGAAGGAAAACTATTTTCAGAGTCTTCTCATGACCTAGCCAC ATTAGCAATCTAAAAATACAAACAGGAAAAGTTTTTAAAAGCTTAACCTTTTATAAAGTGAC TAAACTGCATAAGCCATCAGCCACAGA | SEQ ID NO: 1595 |
| PTPRK | ADXCRPD.13198.C1_at | CACCGGAGGTAGTTGATAGATCGAGAATACACAAGGACACTCACAGTCACACATAGAACCTA GAAACAACACTCCCCAAAACAGATGTAGATTCAACAAAATACTATAAAAAGCCATAAAGCAT ATTCAGTATATAATGTTTAAATTGTTCTGACATATATGTTGTTTGTATACCCGCACAAATGT TACTGTCATTAAACTAATGATCCTATTTTCTTCTTCTCAAAAAAAGTCCTAGAAATCTGTTT GTGATGGCTTGATGAAGTTTAGTCACTTTATAAAAGCCACCTTGG | SEQ ID NO: 1596 |
| PTPRK | ADXCRPD.14082.C1_at | ACTAATATGTTCAAAGTGCCAGGATTCAGTCCTTTCTGGCTATATAATAGGTAACTGAAATC AATGCAGTGAGTGTCGTTCTCCTTCATTGTAGGCAGCTGAAGTCTGGCTTTTTCTCCAGGGT CGTGATCTGAAGAGTCCACTATCATATAGGAACCTTGGGGCATCTCGGGTGGTAGATAATGA GGCTCTTGAGCACTAACATGCACCCATTCAAAGTCATCATACAGATCCTGGTGGTAATCACA GGCCCCTGGAC | SEQ ID NO: 1647 |
| PTPRK | ADXCRPD.6814.C1_s_at | TATAGCATATGATCACTCCAGAGTGATTTTGCAACCCGTAGAGGATGATCCTTCCTCAGATT ATATTAATGCCAACTATATTGATGGCTACCAGAGACCAAGTCATTACATTGCAACCCAAGGT CCCGTTCATGAAACAGTGTATGATTTCTGGAGGATGATTTGGCAAGAACAATCTGCTTGCAT TGTGATGGTTACAAATTTAGTTGAGGTTGGCCGGGTTAAATGCTATAAATATTGGCCTGATG ATACTGAAGTTTA | SEQ ID NO: 1797 |
| PTPRK | ADXCRPDRC.14082.C1_s_at | GGATTCACGGGTAGAGATTGGCTTCGGGCTGAGCTAGCAGTGAGCACCTTTTGGCCCAATGA ATATCAGGTAATATTTGAAGCTGAAGTCTCAGGAGGGAGAAGTGGTTTATATTGCCATTGATG ACATCCAAGTACTGAGTTATCCTTGTGATAAATCTCCTCATTTCCTCCCGTCTAGGGGATGT AGAGGTGAATGCAGGGCAAAACGCTACATTTCAGTGCATTGCCACAGGGAGAGATG | SEQ ID NO: 1980 |
| PTPRK | ADXCRSS.Hs#S2979568_at | TGCTGTGTTAGCAACTGACGTACAATAAAGTTGAATTCACCCGAATATCTAAGTCTTAAAAG ATAAATGCAAGTAGCTGGTAGCTGATTTAGGCACCAGTAACAGAAGTGAACACCTAAAAAGT AAATGCTATCACAGGTAGGAACATGTGAGTGACCCTGATTACTTGTCAGTAGGAAAAGATGT GGAGTGCAGGCATATTCTCTTTCTACTTTGGATCAGCAATCAGATTCACTCACAGATCATCG ATTC | SEQ ID NO: 2148 |
| PTPRK | ADXCRSS.Hs#S794492_at | GACCTTATTATTTCTCAGTTTACATACCAATACTCTCCTATACATACACAATATACTAAGAG GAATACTGTTGTCTTCGTACCCAAATTACACATAAACAGATAAAAACTGACTTTTGCCATCC CTTTGCAAATGTTGTAGCAAATTCTAATGTTCTCAGGCCACGCTGGTTCATGATCCGAGAAT CTGAGACAGTTATAGTCGAAATGTCATAGGAGGCAGGCGTGGTGGCTTGCCCTGTAATTCAG CACTTGGGAGGTCCCTTGGACGA | SEQ ID NO: 2190 |
| PTPRK | RDCR460_E08_at | AGAAATATGCCTTGCCTTCAGAGAATTTATAGAAAGTCTATCTGTCAGTGCTAGGGTCTAG GGGCTGGGAGGAGCTGAGAGCAGCTCTAAAGCCAGGAAGCTGGACCTAAAACAGATGGCTAT TGAGCGAAGTATTTGAAGCTAGATGATGTGTAAGTAATAATATTCTCTGAGCACCTCTATTA TTATTTTTTAGGTTCTCTGCATCAGAATGAGGAAAGAGATTTAATAAGTTGTGAATTTTAAA TTCATGAGAATGCCAATAGAGACC | SEQ ID NO: 1370 |
| PTRF | ADXCRAD_AI282511_s_at | CTTACTTGGGCAGAAATGTATTACTTATTGTGCCTATTTTCTTT | SEQ ID NO: 2833 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| PTRF | ADXCRAD_AL545542_at | GCTCCTTCCCTAGGAGCATGGGTGGCACGTGCC | SEQ ID NO: 2330 |
| PTRF | ADXCRAD_AL545542_x_at | AGGGTGCCGGCCCTGCCACCAAGTTGAGAGCTGGAGGGGAGGTGGGGAGAGAACATCACAGA GCAGCCAGCCCTGGTTCACTCCTGGSAGTTTCTTCTCAAGCTCCTTCCCTAGGAGCATGGGT GGCACGTGCCTGTTGGTCTCAGC | SEQ ID NO: 2331 |
| PTRF | ADXCRAD_BI869786_at | GGTGTATCCCGGTATTTGGTGTACAAACAGTTGGTCCCATTATTGAAGTCGCACTTTTATAT ACACACATAGTACGATGTCAACCGTTGTTTTACACACCGCTGGAGATCGGGCAAAACACGCG AACAGACACGGGGCGAAACCTCGGGCAGAAGCGCACCCCAACATCACAGAGGGGGCTGAACA CCAAGGCGCAAAACTCAACCATAAAGCGAGATTAAAGACAGACGAGGGCACAAAGTAAAACC TGTACACGCGCCAACACGGGACACAA | SEQ ID NO: 2642 |
| PTRF | ADXCRAD_BU186765_at | TTCCATTGAACCCAAAGGTCCGCAACACCTGCCTCCCAGGCCTGGGGCGGAAAAAATTGAAA CACCTCCTCTCCACCTTGAATGGGAGCCTTCAAGGG | SEQ ID NO: 2474 |
| PTRF | ADXCRAD_BU186765_x_at | TCTACTAAGCCGAAACCCATCTCTACTAAAATTACCAAAATTTNCCTGGGCATGATTGCGCA TGCCTGTAAATCCAGCTACTTTTGGAGGCTTGAGGGGGCAGCAATTGCTTGAACCTGGGGA AGGGGGCAGGTTTCCATTGAACCCAAAGGTCCGCAACACCTGCCTCCCAGGCCTGGGGCGGA AAAAATTGAAACACCTCCTCTCCACCTTGAATGGGAGCCTTCAAG | SEQ ID NO: 2475 |
| PTRF | ADXCRPD.10702.C1_s_at | GACAGAGCAGAATGAGCCCTCACCCTGGCTGGGGGTCCAGCACAGGCTGTATCTGCAGAGGG TCCCAGAGGAACGCTGGAGCCAAGAGAAGCCCTGGGAAGGAGGGGTGGGGAACGACATGCAT GTGAGGGATGGCACACTGATGTGTTTATGCACCTGCACACAGGAGCGCATGGCCATGGCTT | SEQ ID NO: 1478 |
| PTRF | ADXCRPD.2246.C1_x_at | TCTCCCCAGTCACAGCCTGAAGGGAGGCCCCGAGAGCTTCCTCCTTCCCCCCACCTGCTCCT TACCTTCTCTGCCCTGCTTTTTAGAAACTGCAGTTCATTGTTTTAAGGGATTGGGGGAGGGAG CCTGGGGACACAAACCTTTTATACAATACAAAGCTTTGCNNNNNNNNNNNNNNNNCTTCCCT TTTCCCNTTTCTCGGTTCTCTTTTCTCTCCTCTGGAATGGGCTGAAGACCCCTCTGCC | SEQ ID NO: 1917 |
| PURA | ADXCRAD_CD677455_at | ACTGCTGCATGACTATCATCTTTGAGTGAAGAGAAA | SEQ ID NO: 2621 |
| PURA | ADXCRAG_BC036087_s_at | ATGCTAAGTGTATTTGTGTTCCCCAAGTGTACAAGCCTTCTATCAAAAGTATGTTCTATAAC TCATATATTCAAGGTGTAGGGTATGAAAATGCAAAGTTTAGGAGAGCACTTTACCAAGCTGG TGTCCTCCAAACTGAAATTGTTTGTAACGATAGTCTTTTACAG | SEQ ID NO: 957 |
| PURA | ADXCRIH.2305.C1_at | CGGAACTCGATGAGCCCCTGCGCGGGCAGCGCAATGGTCTGGCCCTGCGTGGAGCCCAGGCC AGGCCCCCGGTTGACCGTCTGGCGGATGCGCAGGAAGCGGCCGCGCTGGTTCTCCTTGAGAT CCATGTAGTACTTGCGGTTCTCGCGCACCAGGAACTCGCTTTTGAGCGCCCGGCGCGGCTCG TCCTGCGCCTGGGCCAGGTCCGGCGGCTGGCTGGGGCCCAGCTGCGCGTAGTGCTCGATGAA GTCGCCCAGGTAGTCGCGGAACTCCACGGCCACTGACATGGAAAGA | SEQ ID NO: 1117 |
| PURA | ADXCRIH.2305.C1_x_at | CGGAACTCGATGAGCCCCTGCGCGGGCAGCGCAATGGTCTGGCCCTGCGTGGAGCCCAGGCC AGGCCCCCGGTTGACCGTCTGGCGGATGCGCAGGAAGCGGCCGCGCTGGTTCTCCTTGAGAT CCATGTAGTACTTGCGGTTCTCGCGCACCAGGAACTCGCTTTTGAGCGCCCGGCGCGGCTCG TCCTGCGCCTGGGCCAGGTCCGGCGGCTGGCTGGGGCCCAGCTGCGCGTAGTGCTCGATGAA GTCGCCCAGGTAGTCGCGGAACTCCACGGCCACTGACATGGAAAG | SEQ ID NO: 1118 |
| PURA | ADXCRIHRC.2305.C1_s_at | ATGTGGGCTCCAACAAGTACGGCGTGTTTATGCGAGTGAGCGAGGTGAAGCCCACCTATCGC AACTCCATCACCGTGCCCTACAAGGTGTGGGCCAAGTTCGGACACACCTTCTGCAAGTACTC GGAGGAGATGAAGAAGATTCAAGAGAAGCAGAGGGAGAAGCGGGCTGCCTGTGAGCAGCTTC ACCAGCAGCAACAGCAGCAGCAGGAGGAGACCGCCGCTGCCACCCTGCTACTGCAGGGTGAG | SEQ ID NO: 1308 |
| QKI | ADXCRAD_BM931336_s_at | ATGTACTTAGAGCTTTTTGAGTGTAGAATTTTAAATGGCAGGATTTTACAGTGTTTACATGC AAGTGCATTTTATAAGTGTTCTATATGTGTAAAATAGTATTTTCAACTGGAAAGTGTTGGCT AGTGCAAAAGGCCTGGCCATTTTCTGGTTCCCATGATGTTGCCTACACTGCTAGACTACAGT TTAGTATCGCTTTGTATCATGAGGCCAAGAAATTCCATGTTGTTT | SEQ ID NO: 1057 |
| QKI | ADXCRAD_BQ720286_at | ACACTTTCAATTTTATTTGAGGCTTTCCACACTATTTAAAAGGAAAATGTAAGAAATTTGAC ATTCCTGGAGTTATTATAACCATTAGGAAAATGAGCCATAACATTCACCTCCTGATTTTTAC CCATTTAAGGGGGAGAATTAAGTAAAACAGAACTGGCTTACAGGG | SEQ ID NO: 2634 |
| QKI | ADXCRAD_BQ720286_x_at | TCTCAAGCCAACTGCAGCTGGAAAGTGCTGCTTATCCTCCACCCCCAGAAAATGCATGTATC AATATGAGAATAAAGAACGCACACTTTCAATTTTATTTGAGGCTTTCCACACTATTTAAAAG GAAAATGTAAGAAATTTGACATTCCTGGAGTTATTATAACCATTAGGAAAATGAGCCATAAC ATTCACCTCCTGATTTTTACCCATTTAAGGGGGAGAATTAAGTAAAACAGAACTGGCTTACA GGG | SEQ ID NO: 2635 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| QKI | ADXCRAD_BU508110_at | CCATCTACCCCAACAAAAGACAAAGAAATTGTTGTCCTCCACTCAGCTTTTTTTTTTTTTT CCTGTTTGGGGGAAGGTGGTCTAGAAACTGCACGTGATAGTAAGTAAAGCAATTAGGGCCCA ATTCTCCCCACAGCCTGGATCATCTTTTAAATACCCACCCCAAGCCAACGGGAAAAAAGGCC TCCCTTTAAAAGGGGAAAACAAAGGCCCTTACTTACCCCAAGGACAGAGGCCGTTATCGGT GAGAAACTT | SEQ ID NO: 2319 |
| QKI | ADXCRAD_BU508110_x_at | AGCGAGCTGAGGCACTTGTCCGTTCGTCTTACCATCTACCCCAACAAAAGACAAAGAAATTG TTGTCCTCCACTCAGCTTTTTTTTTTTTTTCCTGTTTGGGGGAAGGTGGTCTAGAAACTGC ACGTGATAGTAAGTAAAGCAATTAGGGCCCAATTCTCCCCACAGCCTGGATCATCTTTTAAA TACCCACCCCAAGCCAACGGGAAAAAAGGCCTCCCTTTAAAAGGGGAAAACAAAGGCCCTT ACTTACCCCAAGGACAGAGGCCGTTATCGGTGAGAAACTT | SEQ ID NO: 2320 |
| QKI | ADXCRAD_CK002286_s_at | TTATACCTGGACATTTTAGATGTTTATCAAAGGTCTTTTATGGGGAAGAAAGTAAATGTATG AAATAATAAATGTGTGACATTTATAGGGAATGTTGGCTCTGAACAAACTTTTGAAAACTTGG TTGACAAAATTTTGGATCAACTGAAAAAAGCATGACTTTTGAAATCTCTGAATGCCTTGGTT CTCAGTATTATCATT | SEQ ID NO: 2530 |
| QKI | ADXCRAD_CN295279_at | ACAAGGTACATGCATTATGTGTCACATTACTGGGCAAACTGTTCAAGTATTTTTTTTAAAC CTCCCTGTATAGAAAAAAATCATTAAGGATGTAAAAGCCATGCTTGCCTATTTGCTGTATAC ATGTAATGAAATTGTAGATAAAGTGTAGTGCATTGAAACAAATGAACAAAAAGTAGATACTT TTACTATACAAGGGTGCTGGTGCAGAAAA | SEQ ID NO: 2728 |
| QKI | ADXCRAD_R41907_at | CTGGACAACTTTTTAATGCTGTTTTACCNCAGNGAGAAAGCAATGAACAAAAGCATATTAAC ATATTATCATTTAATTAAAATGTATTCAAACCAACTTTCAACTTGTACTACCAGTATGTCTT AATTTTATA | SEQ ID NO: 2868 |
| QKI | ADXCRAD_AA935633_at | AAGTTTTCTGCCTCCACAATCTTTCAAATGCCAACACAAATAGGAAAAGCAGAACCCCTTAA AGGGACAGCTCAGGTTTTCTCTGGAGCAACTTGAAATTAACAGATTTGCTATTCCAACAGCG GAAAATGCCCATTTCAACGTTGGTGAGTGCTGTATGTTTAACATACGGAAGCAAAACGACGA GAAAGCCGTAACACCTAACCATTTTCTACTTTTAAGTTGTTTCTATGACTTTCAAGACAACA GAACTCCTGGGATTTTT | SEQ ID NO: 2845 |
| QKI | ADXCRAG_AF142421_s_at | AGCTGGCCCTACCATAATGCCTTTGATCAGACAAATACAGACCGCTGTCATGCAAACGGAA CTCCTCACCCAACTGCTGCAATAGTTCCTCCAGGGCCCGAAGCTGGTTTAATCTATACACCC TATGAGTACCCCTACACATTGGCACCAGCTACATCAATCCTTGAGTATCCTATTGAACCT | SEQ ID NO: 866 |
| QKI | ADXCRPD.17514.C1_at | GAAAGTGTTGCCATGAGGGAAGAACTTAAGGGAGTTTAGAAAAGTAATGCGATGACGCAACT GTAACACTATGTTAAAAGGATAGTGTCCTGGGTGAAATTACTGTTGCTTCTTTTACGCCAG AA | SEQ ID NO: 1888 |
| QKI | ADXCRPD.17514.C1_x_at | GCATCATGCATGAACCTTCGGGCAGGATATCATTGGTGAAGTGATTTCAAAAGTATTCAA AATTTGAGATGCTGTTTAGTCACTACAGTGCCCTCAAAGGGCAGAAGTTGCAGCCTTTTTTA TATTGCCTGCCAAAATATGAAGTATTAGAAGAAAGTGTTGCCATGAGGGAAGAACTTAAGGG AGTTTAGAAAAGTAATGCGATGACGCAACTGTAACACTATGTTAAAAGGATAGTGTCCTGG GTGAAATTACTGTTGCTTCTTTTACGCCAGAA | SEQ ID NO: 1889 |
| QKI | ADXCRPD.1932.C1_s_at | GATACAAAATGCAAATCCACAATTTTGATAAACTGAAAATTGCCAATTTGTTTTGCAGTAC TTTATTATATTGGGGTGGCCTTGTCCTTTTTGGGCTTTTAGTTAGCTAATGAATGAATACAT TAGACACTTTTGGGTTTTAGTTGGGATTTTACATAGCTTGCATTTTAATTCTTTGGTTCTTT GCTGTTTCTATTAACCCACAGCATTAT | SEQ ID NO: 1534 |
| RAB31 | ADXCRAD_AL552789_s_at | GACCGACTGGGTATCTAGCTTACTGTTTTAACATCATTGTTGAAACCAGACCCTGTAGTCCA GTGGTGCTGCCCTGTTGTGCAAACTGCTCCTTTTTCTCGTGTTTTTGTAAAGAGCTTCCATC TGGGCTGGACCCAGTTCTTGCACATACAAGACACCGCTGCAGTCAGCTAGGACCTTTCCGCC ATGTATTCTATTCTGTAGTAAAGCATTTCCATCAACAATGCCTAATTGTATCTGTTATTTTT GGTTTAACACACACTGATTCATACT | SEQ ID NO: 2580 |
| RAB31 | ADXCRPD.1938.C1_s_at | AGCCGCCGGTGCTGTTGACCCAAGGGCCGTGGTCCACGGTACTTGAAGAAGCCAGAGCCCAC ATCCTGTGCACTGCTGAAGGACCCTACGCTCGGTGGCCTGGACCCTCACTTTGAGAAGAGTG AGCACACTGGCTTTGCATCCTGGAAGACCTGCAGGGGGCGGGGCAGGAAATGTACCTGAAAA GGATTTTAGAAAACCCTGGGAAAACCCACCACACCACCACAAAATGGCCTTTAGTGTATGAA ATGCACATGGA | SEQ ID NO: 1535 |
| RAB31 | ADXCRPD.2065.C1_at | AATGCGCCGGCCTAACAATAGTTATAAAAAATTGGGGGAGGACAACCTCCCCTTCCCCCTC CCGGATCCCCCGCCCGCCTTTTTTTCCGCCACTATTATCCGCCTCTGCCCCGCCGCCTCAGA ATACCTCTATCCCGCCGCGGAGAAATTNATTCGCGCCCCGTATTTTCTGCCCGCCGCGAACA CGCCCGCCAACCAGTATTCTCGGGAAATAATATAATGGGACTCAAAAACACCGCTCCCCGC CCAAATACGAACGTCGCGGTGGTTATTACTTCTCGCCC | SEQ ID NO: 1412 |
| RAB31 | ADXCRPD.2471.C1_at | GGTTGTAAAGCCTCATTGTAGACAAGGCCTGAGCATCCACAGAAGATACAATGTTTATAT GAATCCTGGTGTGCCCAAGTGTGATCTACTCTCTTCACTGACTACTCTGAGTGCTGATGAGA ATATATATATTATCCTCTGACTGGCTTGAATAGCTAAGACAATACAGAAAGGTAACAGAGTG GTTTCACACCCTCATGTGCTTCTGAAATAAAACCATGGGCTCATTAGTGGGTAGCTCACTAT CTGTGGCAA | SEQ ID NO: 1496 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| RAB31 | ADXCRPD.8667.C1_s_at | GATTGGATTAAAGACCTGGCACTTCAGTAACTCAGCACGCTTCCACTTCACTCAACTTAAGA GAGTTCATTGACAGTGTTAGGATGTGAAGGCTGGGAAACACTTATTTTGCTTCAAGAGTTCC ACTTGGCTCTCCCAAATAGGTACCTCAAAAACTGTTAGCAAGCGGCATTTGGATGTCTTGAC AGGGGCTTTGCAGGGATTTTTAGGGTTTTTTCCACATTGTCCACATTAATGGTTGGCATGAT TGTGCTTGCAGGCAAGAAATGATCATACCCCTTGCCAA | SEQ ID NO: 1406 |
| RAB32 | ADXCRPD.4345.C1_at | TTTGTCATTGTTGCCATCATATGGAAGATAATGTTTACATCCTTTTAAACATTTTTATATGA CAATTCCTCAGGATTTGGTAAGGCTTCCAAGTTGTAGCTT | SEQ ID NO: 1906 |
| RAB32 | ADXCRPD.4345.C1_s_at | ATGTCATGTTAGCTGGGAGTCTTCCCACATGTGGCACTTCAAAAGGCAGCACCACTGGGCGC CTGCACTTATTTGAAAATGGAACTTTGGGAGAAGTATCCCTGCTAGTGGCTCTGTAACTTAA CAGATGACAATTAGGCTTTT | SEQ ID NO: 1907 |
| RND3 | ADXCRPD.11316.C1_at | TTCCACAAACTATGTCATCAGGCTCATTTTTCAAAACCAATGTGCACAACACCTGGTCAAAC TTCTGCGTCAACTACATTCCGTGTCAATAAAATGTTTGCTTTGCCAAGGGAGACTCTGAAA AGTGACCAATATGTAGCAACTGAGAAGTCATTTAAAGGACATCAGA | SEQ ID NO: 1472 |
| RND3 | ADXCRPD.1153.C1_s_at | CACTCAGTTCTATGTCTTACAAGCACTTTGTCTTGTCTCTGCAAGAAAATTCGATTCCAGTC ATTTCCCATAAAATACAGACATTTTACCAACATAATATGCTTTGATTGATGCAGCATTATGC TTTGGGCAGTATTACAAAATAGCTGGCGAGTGCTTTCTGTATTT | SEQ ID NO: 1868 |
| ROBO1 | ADXCRAG_NM_133631_s_at | AGATAAGTATCAGGTCTGACCCCAGTGGAAAACAAAGCCAAACAAAACTGAACCACAAAAAA AAAGGCTGGTGTTCACCAAAACCAAACTTGTTCATTTAGATAATTTGAAAAGTTCCATAGA AAAGGCGTGCAGTACTAAGGGAACAATCCATGTGATTAATGTTTTCATTATGTTCATGTAAG AAGCCCCTTATTTTTAGCCATAATTTTGCATACTGAA | SEQ ID NO: 1051 |
| 41889 | ADXCRAD_AI831470_at | ATTAAGTTTATCCTTTTCTCCATCTTTTCTTCTTGCCACCTAATGAAGGAAATGTCTCCAA GGTCTTTTTGACTAATAGAAACTAAATGTATAACTCGACATCTAGAAGGGTTTCAAGATAGT AGATATGTCTGCTGGGATGTTTTGTCATTACCCTGCCCAATGTTGCGACGCTAGGAGTTTCC TTGACACTACATTATAAATAAGGCCCAACCTGTTAGCAAAAATATCACATTCCCTAATTTTC TCTCCTTTAACTGTGTGTAATTTATCCAGGCATGTCTTTAGTTCAG | SEQ ID NO: 2805 |
| 41889 | ADXCRAD_BF855173_at | AAGGTACTTAGAGCTCTTACTTTCTAAGTACAGAACACCCTAGACAATTCAAGGCATCTTAA TCTCCATCAAGAACAAAAAAAAAAAATAATTTTGGTCATGCGGTTAAATCCATCATTAGGGAT AAAACGGGTGCAAATGGGTCAAAGGGATCCAACAAACACGGATGTCCAAGCGGGCATATGGG CAACTATTACGTTAACGGGGGGTCAATAGAGAGTTAAAAAGATCTTCCCTTTCTTCTGGTTC TTTTCCAGGGTTCTGGAAGAGTTCTGGT | SEQ ID NO: 2333 |
| 41889 | ADXCRAD_N39126_at | CAACAGAAAGATGGACTAAATATAAAGGGGGGAATTCCTGGACCTCCTTTGGGTGGCTAGAC TGGTANGTCATAGGCTAAGCCGGAAGGGTGG | SEQ ID NO: 2855 |
| 41889 | ADXCRAD_N39126_s_at | AAACAAGTACAATATCCTGGCATAAAACTATCTTTCAGACAAAATCCACCTGCTGTGTATTA AAAAATGTAATACTTGAAAACTTCCTGCCTTGGGAGAGACTAAACCCGATTCATAATACAAA | SEQ ID NO: 2856 |
| 41889 | ADXCRIH.335.C3_s_at | TTACACTTTATGGTAAGTAGCAGGGGGGGAAATGCATTTATAGATCATTTCTAGGCAAAATT GTGAAGCTAATGACCAACCTGTTTCTACCTATATGCAGTCTCTTTATTTTACTAGAAATGGG AATCATGGCCTCTTGAAGAGAAAAAAGTCACCATTCTGCATTTAGCTGTAT | SEQ ID NO: 1260 |
| 41889 | ADXCRPD.177.C1_s_at | ATAAAGGACCGTTTACCTCTTGCTGTGGTAGGTAGTAATACTATCATTGAAGTTAATGGCAA AAGGGTCAGAGGAAGGCAGTATCCTTGGGGTGTTGCTGAAGTTGAAAATGGTGAACATTGTG ATTTTACAATCCTAAGAAATATGTTGATAAGAACACACATGCAGGACTTGAAAGATGTTACT AATAATGTCCACTATGAGAACT | SEQ ID NO: 1905 |
| 41889 | ADXCRSS.Hs#S1914581_at | GGGCCCAGAGTTTGCTCCCAGGGAATCTAATGAACCACCTGGAATCAAACATTTGGAGAGA GGCCAGTCACTTTTATCGGAACGTCAGATGGTCATGGACCCTCAAGAATGATTGAAGAAATT TGTAAGCCCAGTTAAAACATCCACAGTCTTCTTTCCTCAGTGCAAAAGTTGCCCTTTTTGAT ATCTCATATTTAGAGTAAAAAATTTCGTTAATAAGAGATCCTCT | SEQ ID NO: 2088 |
| SCRN1 | ADXCRAD_CK001870_at | AGATGGAAATGCTATTGGCGGGAATATATAAAAAAAAGAATCTTCTGTTCTGCATGG | SEQ ID NO: 2046 |
| SCRN1 | ADXCRAD_CK001870_s_at | GAGCAGCAGGTCATGTGCACATGCCGTTGCAGCACAAGCTTATGCTTCCCGTAGCCGTGGCT TTTCATTCTGCACAGTCCCAGGTCCCAGCTCCCCTCTTATGGTTTCTGTCATAATGTGCTTT ATCTGATTGACTCCAAACATCCCGAAATGTCACCTGCAGATTTCTCGTGGGAACCAATATGT ACATGTT | SEQ ID NO: 2047 |
| SCRN1 | ADXCRIH.243.C1_at | ATAATCGAAATTATGGAGGTTCCTTAGTGCTCAATAATAATAAGACCTGTTGTTATTAGAACG AGTCTTTCTTATAAACTAACAGAGCAGGTATATGCCTGTTAGATCTTAGCTGTGGGGTTCCT TTACTATTGGGTGAATCATTAGGTATAAAAAATAATCATCAACCAGGCCAAATACTTTGCTT | SEQ ID NO: 1256 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| | | CCTAGCTGATGTCATCCCACATTGGTACAGTGTTATTCATTACTGGGTGGTTCAACAGGGAA GCCAGTGGGA | |
| SCRN1 | ADXCRIH.243.C1_s_at | GGTTCCTTTACTATTGGGTGAATCATTAGGTATAAAAAATAATCATCAACCAGGCCAAATAC TTTGCTTCCTAGCTGATGTCATCCCACATTGGTACAGTGTTATTCATTACTGGGTGGTTCAA CAGGGAAGCCAGTGGGACCAGTGTGTCTGTCATGAAAC | SEQ ID NO: 1257 |
| SCRN1 | ADXCRPD.2301.C1_at | CACGTGCTTCCTTACTAAGGCTGAGAGCTCAACTGAAGACCTTCCCCAATAAATGACAGATG GCTCTTCAGTCAGGAATGCAGTTAGTGGTTTCATGACAGACACACTGGTCCCACCTGGCTTC CCTGCTGAACCACCCAGTACTGAATAACACCTGTACCAATGTGGGATGACATCAGCTAGGAA GCAAAGTAATTTGCCTGGTTGATGATTATTTTTTATACCTAATGATTCACCCAATAGTAAAG GAACCCCACAGCTAAGATC | SEQ ID NO: 1899 |
| SNAPC1 | ADXCRPD.2725.C1_at | GAAAGAATCCATCCTTAAAGTCAAAAACTAATGATGGAGAAGAAAAAATGGAAGGAAATACA CAAGAAACGGAGAGATGTGAAAGGGCAGAATCATTAGCGAAAATAAAATCAAAGGCCTTTTC AGTTGTCATACAGGCATCCAAATCAAGAAGGCATCATCAAGTCAAACTCGACTCTTCGGACT CTGATTCTGCATCTGGTCAAGGCAAGTCAAAGCAACTAGGAAAAAAGAGAAGAAAGAAAGAG TGAAACCAGCAGGAAGGAAGATGTCTCTCTAGAATAATAC | SEQ ID NO: 1555 |
| SPTAN1 | ADXCRAD_CA435088_s_at | AATTGATTTCTATTTGCCATTCTCCAAAAGACAAAAAAAGTTGGTTTTTTTTTTTTCGGTC TTTTGTTTGTTTGTTTGTTTTTTAAAAAATAGGGTCTTGCTTTGTTGCCCAAACTGGAGGTC AGTGGCTTTTCACAGCTGCAGTTATAGCCTACTGCA | SEQ ID NO: 2571 |
| SPTAN1 | ADXCRPD.3100.C1_s_at | TCCGGTCCAGTCACAATCATCATGTCACTGTGGGGACCCAGATCTGTGTCTTGAAGCAGCTG CCCTCATTCCGACTTCAGAAAATCGAAGCAGCTGGCTCCTCC | SEQ ID NO: 2277 |
| SPTAN1 | ADXCRPD.9848.C1_at | TCAGTTCAACTGAGCGACGTGTATACTCCTGGGCGTGAAACAG | SEQ ID NO: 2293 |
| SPTAN1 | ADXCRPD.9848.C1_s_at | AAGATTATGGCGACACTCTTGCCGCCATCCAGGGCTTACTGAAGAAACATGAAGCTTTTGAG ACAGACTTCACCGTCCACAAGGATCGCGTGAATGATGTCTGCACCAATGGACAAGACCTCAT TAAGAAGAACAATCACCATGAGGAGAACATCTCTTCAAAGATGAAGGGCCTGAACGGGAAAG TGTCAGACCTGGAAAAGCTGCAGCCCAGAGAAAGGCGAAGCTGGATGAGAACTCGGCCTTC CTTCAGTTCAA | SEQ ID NO: 2294 |
| SPTAN1 | ADXCRPD.9848.C2_at | GAGGAGAACGACAAACTGCGCCAGGAGTTTGCCCAGCACGCCAACGCCTTCCACCAGTGGAT CCAAGAGACCAGGACATACCTCCTCGATGGGTCCTGTATGGTGGAAGAGTCGGGGACCCTCG AATCCCAGCTTGAAGCTACCAACGCAAGCACCAGGAAATCCGAGCCATGAGAAGTCAGCTCA AAAAGATCGAGGACCTGGGCCGCCATGGAGGAGCCCTCATCCTGGACA | SEQ ID NO: 2295 |
| STK17A | ADXCRAD_AW183478_at | GAAATTCAACAATGAGCATCTGTCCTTCCTCTATACCACTACTAGAGAAAGGGATTAATTAC CTCCTAGTTTTCATTTGAAAACAACAAAACACAAGATCAATCAAATATCATTTCCCAGTTGA TTAAAACTTATACATTTTATACATTTCATAAACAACGTTTCACCACACCAAAATATTGTTGA ATTATAGTTAAAACTGGATTTATAAACCGAGTAAACTCAATAGTACTGGTTAGTCCTTTATA AATTTGGGGATAGAAAAAAGGAACATTAACAGCTTTAGATAAG | SEQ ID NO: 2801 |
| STK17A | ADXCRAD_BQ227453_s_at | AACTTTGTCAAATTTGTGGAGTTAGGTGGAAGCCAGATTTTAAAAGTTGCCAACCAGGATAT TTAACAGGTACAGTTACCCGTTTCAATGTTATTTTTAAGAAGGGAGATGTTGGCACCTTTGA ATTCTACATCCTGTTTCTC | SEQ ID NO: 2617 |
| STK17A | ADXCRAD_AA234664_at | AAGTGAGTAAAATCCCCTAGAGCAGAGAGAGAGAGAGAGAGAGTGTCTTCATGCCAAC CACAGCCTGTTTCTGCTGAGTTTCTTATCAGCCCTCAAGCTATGCTAGGAAAAGTTATAAAA TGCCAAAATATTTATAAACATTTACTTTGTCCATAAAATATTTACATTGGATACTCTGTAAG TAGGAGGTACTTTGTCCCAAAAAGATGTATAAGAATGTACTAATAGTTTTATTTGATTAGGA TTGAACAGTTCAGTTGTATCTATGCCCCACAGTGACCAGTAAAGT | SEQ ID NO: 2398 |
| STK17A | ADXCRPD.362.C1_at | GCCGACCGGCGCACATGTGATAAGAAGATACTGTGGGGTGGCCCCCCCTTGCGGCCCCCCAG AAAGAAATCTTTTTAAAACCCCCTTTTTCTTTTTGGGCGGCCGCGGGGGCGCCCCCCCGAT AGGGGACAAGGCCGGGATACGGGGGGCTCGAAACCGTTGTGGCCCCTTCCACAGAGGAAGA TACCCGGTGGCCACCCGGATAAATAACCGCGGCCTGTGTGTTT | SEQ ID NO: 1909 |
| STK17A | ADXCRPD.7382.C1_at | AACGACTTATGCGACCAGATTTTAGAAGGTGTACACTATTTTACAACACTCGTGACTGTAGT TCATCTGGCATTTGAAGCCTCAGGAATATTCTGGTGAACCAGTGAATCTCCATTGGGTGACA TTACCGATCGCAGATTTGGGCTACCCAAGACTATTGAAGACCAGTGAAGACTGAGGAACA TCATGGGTAACCCTGAATATGTGGGTCCGGACATCCTAAGTTATGATCCTCATAGCCATGCC ACA | SEQ ID NO: 1784 |
| SVIL | ADXCRAD_CA396083_s_at | GAAGCTTGAGATCTATCTCACCGACGAAGACTTCGAGTTTGCACTAGACATGACGAGGGATG AATACAACGCCCTGCCCGCCTGGAAGCAGGTGAACCTGAAGAAAGCAAAAGGCCTGTTCTGA GTGGGGAGACGCCAGAGGAGCCTCACGGTCACGTCCAACAACACCACTGCACCAGGGAAATG GATAT | SEQ ID NO: 846 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| SVIL | ADXCRAD_CN402078_s_at | GTATCTTCATACACGTTTGGAAATGTTTCCTGCAGCATTAGGTATGACTTGTTCTGAGTACT GCTTCCGGTGCTAAAATGAACAAAGAATTTGTACTTAATGGCATGGACTCTGGAGAATCTAT GCGAATCAACCTTTCTACCTTAATATCTCCCCAAAAATGTATAGTGCCTTGTTTTTATGTAC AGTTTATATACAGAAAAGTTTGCTCTGCATTTTTGATGATGGTTTGGAACATTATCTACAAT | SEQ ID NO: 1315 |
| SVIL | ADXCRIH.3823.C1_at | GGCATTGCCTAGCTGGAACAAGAAGGCAGTGCTATCTATAGCAGCTGCGGCTTAAGTGCACA TAACAGATACTTTTATTAATTCTGATAACCTCCTGAATGGTGGAAAGAAGTTTCCAAACAGT TCCCTTGAACATTTACAAAATACACAACTCCGGGACAGCAGTATCTTTAACAATGTCATGTT CTGAAAACTCTGAT | SEQ ID NO: 1176 |
| SVIL | ADXCRIHRC.3823.C1_at | ACCGGTTGTAAAAACAGTACACATGTCATTTTGTGATATAGGACTCCCAAATAAAAGTATCA GAATAAACACCTCGTGC | SEQ ID NO: 1314 |
| SVIL | ADXCRPD.12020.C1_s_at | GCTTCTGGGTGGCCAAACCAGTTACCCAATCTGCTGGAGACCCAAAAGAAGATGAACTCTAT GAAGCAGCCATAATAGAAACTAACTGCATTTACCGTCTCATGGATGACAAACTTGTTCCTGA TGACGACTACTGGGGAAAATTCCGAAGTGCTCCCTTCTGCAACCCAAAGAGGTACTGGTGT ATGATTTTGGTAGTGAAGTTTACGTATGGCATGGGAAAGAAGTCACATTAGCACAACGAAA | SEQ ID NO: 1489 |
| SVIL | ADXCRPD.9920.C1_at | GTGAGTCAAGAAGGCCCTCCCCTGTCGGCGTTTGATCTCTCCAGCAGCAAACATCGCACATG GATTCTTGCAGAGCTTCTCCTGCGGCTGTTCCGAAGAATCCTGGGGCTTCCAGGACACGGGG GCTGTGGTTTAAGCAATAGTTTTCCCAGCAGCTGTCCCCGTCTGCTCGGAAGTGGGCTCCCC GAACTCTGCCGCTCTTAGTGAAAACTTCCTTTTCATAACATTCTCCACCTCCACCTTCTCTT CAAAGGGCAGCCTGTCCTCAAGTC | SEQ ID NO: 1551 |
| SVIL | ADXCRPDRC.9920.C1_at | CATGTCTATAAAGAAAGATGGCACTGTTGAAGAAAAGCGGGGAGGAAGATTGGAGAAACAGA CTCAGCAGGAGGCAGGAGGGCGGCAGCGCCGCCACAGCCGCACACCCAGAAGCAGGCGTCCC TCATCAGAAGCGT | SEQ ID NO: 1963 |
| SVIL | ADXCRPDRC.9920.C1_s_at | TGGAAGCCCCAGGATTCTTCGGAACAGCCGCAGGAGAAGCTCTGCAAGAATCCATGTGCGAT GTTTGCTGCTGGAGAGATCAAACGCCGACAGGGGAGGGCCTTCTTGACTCACCCAGCAA | SEQ ID NO: 1964 |
| TFE3 | ADXCRPD.14170.C1_at | CCTTTTGAAGGCACGGCAGAACGAAAGACATCAACAACCTTAATTTGAGCGTCGCAAGGCGA TTCCAACATTTACCGACAGGAATCAGGGAACTGGGGCCTCCTCATCCTAGTCCAGTGACCGG AGA | SEQ ID NO: 1660 |
| TFE3 | ADXCRPD.2523.C1_s_at | TTATTGCTCCGCATACTGAGAATCTAGGCCACCCCAACCTCTGTTCCCCACCCAGTTCTTCA TTTGGAGGAATCACCCCA | SEQ ID NO: 1520 |
| THY1 | ADXCRAD_BM704951_at | CTGGAATCTGTCCTCGTGTCCACCTGGCCTTCGCTCCTCCAGCAGTGCCTGCCTGCCCCCGC TTCGCTGGGGTCTCCACGGGTGAGGCTGGGGAACGCCACCTCTTCCTCTTCCCTGACTTCTC CCCAACCACTTAGTANCAACGCTACCCCAGGGGCTAATGACTGCACACTGGGC | SEQ ID NO: 2556 |
| THY1 | ADXCRAD_BM704951_x_at | GTTCTTCCTGTTCTGTGACTGTGTATAGTGCCACCACAGCTTATGGCATCTCATTGAGGACA AAGAAAACTGCACAATAAAACCAAGCCTCTGGAATCTGTCCTCGTGTCCACCTGGCCTTCGC TCCTCCAGCAGTGCCTGCCTGCCCCCGCTTCGCTGGGGTCTCCACGGGTGAGGCTGGGGAAC GCCACCTCTTCCTCTTCCCTGACTTCTCCCCAACCACTTAGTANCAACGCTACCCCAGGGGC TAATGACTGCACACTGGGCTTCTTTTCAGAATGACCCTAACAAGACACAT | SEQ ID NO: 2557 |
| THY1 | ADXCRPD.3397.C1_at | AAAGAGCACGTGCTTCTTTGTCTCACGGGTCAGGCTGAACTCGTACTGGATGGGTGAACTGC TGGTATTCTCATGGCGGCAGTCCAGACGAAGGCTCTGGTCCACTAGGCAGGCCGTTAGGCTG GTCACCTTCTGCCCTCGGGAGACCTGCAAGACTGTTAGCAGGAGAGCGATGCTGATGGCCAG GCTCATGGTTCTGGGATCTCAGTCCTGGATCTGGACTGGGTCTTCCGCTG | SEQ ID NO: 1904 |
| THY1 | ADXCRPDRC.3397.C1_s_at | CATCCTTGCCCATCGGGACCAGAAACCTGGGAGAGACTTGGATGAGGAGTGGTTGGGCTGTG CCTGGGCCTAGCACGGACATGGTCTGTCCTGACAGCACTCCTCGGCAGGCATGGCTGGTGCC TGAAGACCCCAGATGTGAGGGCACCACCAAGAATTTGTGGCCTACCTTGTGAGGGAGAGAAC TGAGCATCTCCAGCATTCT | SEQ ID NO: 2049 |
| TIMP2 | ADXCRPD.1038.C1_s_at | ACTTGCTGCCGTAATTTAAAGCTCTGTTGATTTTGTTTCCGTTTGGATTTTTGGGGAGGGG AGCACTGTGTTTATGCTGGAATATGAAGTCTGAGACCTTCCGGTGCTGGGAACACACAAGAG TTGTTGAAAGTTGACAAGCAGACTGCGCATGTCTCTGATGCTTTGTATCATTCTTGAGCAAT CGCTCGGTCCGTGGACAATAA | SEQ ID NO: 1841 |
| TMEM158 | ADXCRPD.7689.C1_at | AACAAATACACAGGATTTGGTCATTTTCTGCCATGAATCTAGGGCACGTGGGTGCCGGGAAG GAGTCGGGCAGGGGGATGCAATGAGGGGAAAGGGCCCCATTTCCCTCCTCTCGTCTTCGG AGCTGCGATCCCACCCTCAGTCCAAGGGCTTAAACATCTGCTTTTCGGAACTGGAAGCGCAG CACAAACCTTG | SEQ ID NO: 1836 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| TMEM158 | ADXCRPD.7689.C1_x_at | AACAAATACACAGGATTTGGTCATTTTCTGCCATGAATCTAGGGCACGTGGGTGCCGGGAAG GAGTCGGGCAGGGGGATGCAATAGAGGGGAAAGGGCCCCATTTCCCTCCTCTCCGTCTTCGG AGCTGCGATCCCACCCTCAGTCCAAGGGCTTAAACATCTGCTTTTCGGAACTGGAAGCGCAG CACAAACCTTGCTTTTCAAAGGCGCTGGG | SEQ ID NO: 1837 |
| TMEM158 | ADXCRPDRC.7689.C1_s_at | GATTAAATTGCTATTGCTGTAGTAAGAGAAGCTCTTTGTATCTGAACATAGTTGTATTTGAA ATTTGTGGTTTTTTAATTTATTTAAAATTGGGGGGAGGGCATGGGAAGGATTTAACACCGAT ATATTGTTACCGCTGAAAATGAACTTTATGAACCTTTTCCAAGTTGATCTATCCAGTGACGT GGCCTGGTGGGCGTTTCTTCTTGTACT | SEQ ID NO: 2034 |
| TRAM2 | ADXCRAD_BM700086_s_at | AGGCTGTGTCATTGGCAGGGCTTCACATGCAGGAGGCCTCTCTCAGGTGAGTCCAGGTTAAA CTGTTGAGTTGTGGCTTCAACAGATATGTATGGCATGCTGGGATGTGCCAGGTGCCTGCGTT GTGCCAGTTGCTGGAGAGGTAGTGTGAGCAGAGCAGCTGAAATCTTGCCATCAAGCAACCCT CATTCTCATGCCTGTAGGTTTCCATTGCTCTGTCCCAGGACACTTGCGTGCCAGAGACGCCA CAACTTCATGTCCCTGTCTCTTGCAA | SEQ ID NO: 2739 |
| TRAM2 | ADXCRAD_BM789115_s_at | TGGTGCCCTGAGCAACTGATAATGCAAATGTGGACAAAGTGTCTGTTTTCTACTCTAGCCTG TTCATATGGACCAAATTTCAACAAGGAACTCAAGGAAAATTTGTACCTGCCGTATTTATGCT TTCATGTAAAAAGGGTTGGGGGGAGGGGTGTCTTTTTGCTTTTGGTGAACTTTTTTTCAAA ATCATTTTTCCACTGTTTCTGTCTGGTTTTAAAACAAATTTACAGTTTTGTATGGATTTT | SEQ ID NO: 988 |
| TRIB2 | ADXCRAD_CX783483_at | ATCCTGGTCAGGAAATGACATGTTAATGCTTTGCTC | SEQ ID NO: 2393 |
| TRIB2 | ADXCRAD_CX783483_s_at | ACACATCCTGGCATCGCACTGTTAGCATTTAATTTCTTGTTAGGATTCAGGGAAGGAACAGT TGGCCAAGAATTTTTTTTCTTTTAAACAAGCCAACCACCTAGCTGGTAATTAATGAGGTTCA CTTAAAAAAAAAATTCGGTGCACACAGACTGACATGAAACCTGGGTGCTACAGTAAAAGAAA ACAAAAGTCCAGTTTGTGTCTCTTAATCGCTCACTTCAACTCATTTCTTCTAAA | SEQ ID NO: 2394 |
| TRIB2 | ADXCRPD.1189.C1_s_at | GGCTTCACCCTTCGTAACCAGGAGACAAGGCGGCCATGGATTTGCCCTTGATTCTATTTTGC TAATGGAAGATAGAAAGGAGAGAAGGNNNNNNNNNNNNNNNAACATTCTGAAGATGGTGCTGT GTCAAGAAGGACCTTTTTTTTCCCCTCTCCCTATTTTTTAAGTACCTTGGAGGAGGAGAGG TTGGTGACATGCATGGTGGGGATCTATGGCCTC | SEQ ID NO: 1870 |
| TUBB | ADXCRAD_CX872111_at | AACATGAACGACCTCGTCTCTGAGTATCAGCAG | SEQ ID NO: 2481 |
| TUBB | ADXCRAD_CX872111_s_at | GTATCAGCAGTACCAGGATGCCACCGCAGAAGAGGAGGAGGATTTCGGTGAGGAGGCCGAAG AGGAGGCCTAAGGCAGAGCCCCCATCACCTCAGGCTTCTCAGTTCCCTTAGCCGTCTTACTC AACTGCCCCTTTCCTCTCCCTCAGATTTGTGTTTGCTG | SEQ ID NO: 2482 |
| TUBB | ADXCRIH.194.C3_at | TCCAGAAACGTCTTCTTAATCCCCACCTTTTCTTACTCCCAAAAAAGAATGAACACCCCTGA CTCTGGAATGGTGTATACTGCCACATCAGTGTTTGAGTCAGTCCCCAGAAGAGAGGGGAACC CTCCTCCATCTTTTTTGCAACATCTCATTCTTCCTTTTGCTGTTGCTTCCCCCCTCACACA CTTGGTTTTGTTCTATCCTACATTTGAGATTTC | SEQ ID NO: 1261 |
| TUBB | ADXCRIH.194.C3_x_at | TCCAGAAACGTCTTCTTAATCCCCACCTTTTCTTACTCCCAAAAAAGAATGAACACCCCTGA CTCTGGAATGGTGTATACTGCCACATCAGTGTTTGAGTCAGTCCCCAGAAGAGAGGGGAACC CTCCTCCATCTTTTTTGCAACATCTCATTCTTCCTTTTGCTGTTGCTTCCCCCCTCACACA CTTGGTTTTGTTCTATCCTACATTTGAGATTTCTATTTTGTGTTGAACTTGCTGCTTTTTT CATATTGAAAAGATGACATCGCCCCAAGAGCCAAAAA | SEQ ID NO: 1262 |
| ULK2 | ADXCRAD_BP319713_at | GAGCTTTTCCATTTGGTGCTCCAATGTCTCCTGCTGGACCCATCTGCCTAGTGGAAGGCAGC AAAATTTCAAGAAACAGGTGAGGTTGAGCAGCTTGGTGCAACCCCATGGG | SEQ ID NO: 2317 |
| ULK2 | ADXCRAD_BP319713_x_at | AGAGAAGACTGTCGGCGCTCTGCCATAGCACCGCAACCGTGTGAGCAGCAGGCTCATCCCGT GGACCGGTGGTGGGAACGTGAGGAAGAGGGGAAGGAAGGAAGAGCTTTTCCATTTGGTGCTC CAATGTCTCCTGCTGGACCCATCTGCCTAGTGGAAGGCAGCAAAATTTCAAGAAACAGGTGA GGTTGAGCAGCTTGGTGCAACCCCATGGGGCCCTGGAGTTGGAGCTCAACAGCAATGGATTT CAGA | SEQ ID NO: 2318 |
| ULK2 | ADXCRAD_CK818454_s_at | AGTTGGTGACCTAAAGGCTTGTTAGTGATGTGGAGTTCCTACATGCAGTGAGTGGAAAATGA AGTTCGTTTTCTCTTAGGAAAATGGGCAGCTGTCTTCTGCCTAATGTGTATTTTTCATGTTA ATTCTGACAGTTCACCAAATAGCTAGTCATGGAGAATGCAGGCAGTTAACTTAATATCCCTC CAGGAATGGTTCCTACGTTGTGTATTATTTGGTTCTTTTACTTACCTGCTTGAATACT | SEQ ID NO: 2421 |
| ULK2 | ADXCRAD_NM_014683_at | AAGTGATTGGCCTAAAGTCAGGAACTAGGCAAGTGGTCAAGCCATGCTTTGTGACTTTCAAG TTAATTCTTCTTGTTCTTGTATATTAAAGGTCTTGGGGTAGATGGTGTGTGTGAAACAGTGA AGTCTCAACAGCAGAAAAGAACAAAATGTAAATTCATGAATAATGGTTCTGGTTATACTTCC ATTATCAAGGCTAATTAAGAGATTTTGCCTTGAGTATAGCAATAATAAACAAATGCTTTATG TTTCCCT | SEQ ID NO: 2771 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| USP33 | ADXCRAD_BP275873_s_at | GAAGACCTGGTTTTGATGCTGCCTCAGAACATTTGGGATAACCTATATAGCAGGTATGGTGG AGGACCAGCTGTCAACCATCTGTACATTTGTCATACTTGCCAAATTGAGGCGGAGAAAATTG AAAAAGAAGAAAAACTGAATTGGAAATTTTTATTCGGCTTAACAGAGCGTTCCAAAAAGAG GACTCTCCAGCTACTTTTTATTGCATCAGTATGCAGTGGTTTAGAGAATGGGAAGTTTTGTG AAGGGTAAAGATGGAGATCCTCCAGGTCCTATTGA | SEQ ID NO: 2569 |
| USP33 | ADXCRAG_AF383172_s_at | CATGAAGTGTGGAATGTGTCACTACGATTGTTGATAAAGCTGAGGCCACTTGCAACTTGATT TTTTAAATGAAATAGATAAAGTCTTTTTGAATAATATAGTATGCACTGCTATTTGCTTGATT ATGTAATGTCAAAAGTTTAACTATATTCCAAGTACAAAAACATACTGGATTACATTGAGGAT GTTGAATAGCATTCATGATGGCTTTGTTTTGGTTTGGGGCAGCTGTCACCAGCTAAAGCAA TG | SEQ ID NO: 876 |
| VIM | ADXCRAD_AL046837_s_at | TTTTAAACTTGGCTGTATTGTGTACAACTATTATACCATCTTTTATAAACACAGTTTTTTAA GAAATTTCTTTTTGTAAGTTACAACATTCCACTGGATCCTTTATATTGCCTGTAGTGGAAGAG GGTCTTGTGTGTCTGCCCCTTCTAGTTTTCACTCATGCAGAAGCAACATAACCTTCTGATTT GCACAATAAATNACATATATTTAGCAGGATTTTTATTTGCCGTGATATATAGGATAATTTAG TCTTTGGCATGTGGC | SEQ ID NO: 953 |
| VIM | ADXCRAD_CX873552_s_at | AAGCAGGAGTCCACTGAGTACCGGAGACAGGTGCAGTCCCTCACCTGTGAAGTGGATGCCCT TAAAGGAACCAATGAGTCCCTGGAACGCCAGATGCGTGAAATGGAAGAGAACTTTGCCGTTG AAGCTGCTAACTACCAAGACACTATTGGCCGCCTGCAGGATGAGATTCAGAATATGAAGGAG GAAATGGCTCGTCACCTTCGTGAATACCAAGACCTGCTCAATGTTAAGATGGCCCTTGACAT TGAGATTGC | SEQ ID NO: 1312 |
| VIM | ADXCRIH.436.C1_at | TATTCTGAATCTCATCCTGCAGGCGGCCAATAGTGTCTTGGTAGTTAGCAGCTTCAACGGCA AAGTTCTCTTCCATTTCACGCATCTGGCGTTCCAGGGACTCATTGGTTCCTTTAAGGGCATC CACTTCACAGGTGAGGGACTGCACCTGTCTCCGGTACTCAGTGGACTCCTGCTTTGCCTGGC GCAGGGCGTCATTGTTCCGGTTGGCAGCCTCAGAGAGTCAGCAAACTTGGATTTCCTCTTCG TGGAGTTTCTTCAAAAGGCAATCTCTTCTTGCAAAGAT | SEQ ID NO: 1159 |
| ZNF331 | ADXCRAD_AW959541_s_at | TCATGCCACCCACTCTACCAGTTGTCCCCACCATCCCCGCCCTCCTTCCTGTGAGACACTG GGCCAAAGGCTCACTACCCCTGTGCGTTGTCCAGCACACAGACACTATGTGCATTATTGTA CATAAGGATAATCACATCTACCTGAGACTGCTATCATG | SEQ ID NO: 2447 |
| ZNF331 | ADXCRAD_BU176917_at | TAAGTCTCGAATGGTGTGGCCCTTCTGAGTAGCGTGATGAAATCTCTCGCTGTCCGGGTCCA CCCCGGCCGGGGATGTGAGTCATCCCCTTGGTCCAGCACATCCACGCTGTATACACCACCCAC CCTGGTAGTGACTTAGTAACCGGCCTTGGTGATCAGGGATCAACTATGCCAACATCCGCAGT GCCCTGTGGCCCAAAGCAGGGCCTCACGTTTGGCTTTAACGGGGGGGCCCCAGGGGAGGCCA GGAATAGGGGGATTGCCTGGGTGGATTCCAGAATA | SEQ ID NO: 2683 |
| AAK1 | ADXCRAD_BP360257_at | GGCAACACCTCGGCCCTGGGCAGGGGCTACATTGGAAAAATCTTCGGCATGGGGCGAAAGAA GGTCACAGTGAACAAGGGGTTGGCGAAA | SEQ ID NO: 2628 |
| AAK1 | ADXCRAD_BP360257_x_at | TCCTCTCCGAGGTGAAATCTGAGAAGAAATCCTTGGATCTCTTTTCTTAAAAAAAAAAAAAA AAAAAAACTTCTGAAACCCAGGGGGTTTTGGCTTGGCGGCCCCCTATCCCCAAAAAAAAAA AGTTTTTCAACTCCCGGGAAAACAGGGGGGTTTTGGCCTGGGCTCCCGGCTCCAGGGGGGGA GGGGGCAACACCTCGGCCCTGGGCAGGGGCTACATTGGAAAAATCTTCGGCATGGGGCGAAA GAAGGTCACAGTGAACAAGGGGTTGGCGAAAGGGGGATTGGCTATTGAATT | SEQ ID NO: 2629 |
| AAK1 | ADXCRAG_AB028971_s_at | TGCTGAGCGGCTTATGTTCTGAATTTGTTTATGAGAACTGATCATTAGTGAGACTGGCCACA GTATTTAACCTTGCACATGCATGCTCAGTGAAGCCTAGACATTCAGAGCAGCAGAAATAAAG TAACTTATTTTTCTTTCCACCTTGCCTGAGACTGGCATTTTAGAGACCTGTTAA | SEQ ID NO: 836 |
| AAK1 | ADXCRAG_NM_014911_s_at | GAAGCCAAGGCTATTTAATCTCACTTGTATCACTCCAAATGAAGTGTTTTCCTTGCTTTTCG GGGGTACAACGTCTATTTTTTGCCTTTCTTGATATCTGGAGATTTCTAGAGTGGATCTCTTA TGAATGAGGAGGAATGTGAAAGTTTCACATTTAGTTAGAAGAACTTTAAAAAATTGGTTTC TAACTAGACTACCTTTACTGAACTTAATGAAATTTAGCAGATTCTTCTT | SEQ ID NO: 1044 |
| AAK1 | ADXCRAG_XM_371497_x_at | CACTCTGGGAGGCTGTGTTGGGCCGATCGCTTGAGCTCATGAGTTCAAGACCAACCTGGGCA ACATGGCAAAACCTTGTCTCTACAAAAAATACAAAAATTAGCCAGGCATGGTGGTGCACACC TGTAGTCCCAGCTACTTGGGAGGCTTAGGTGGGAGGATGGCTTGAGCACGGAGGCAGAGGT TGCACTAAGCCAAGATCGTGTCACTGCACTCCAGCCCAGGCAATAGAGCCAGACCCTGT | SEQ ID NO: 1090 |
| AAK1 | ADXCRPD.17316.C1_at | TCTTCTGCAGCTTTATGGACTGGAGCAGAGATTGCTGTGGGGGCAAACTCTTCCAGAAGGTC AGTAGTAGGGTTAGAGAGCAGAGAGCAATCAAGCAGGGAATCTTCCCCGGTGAGAGAATCTG TGCGATTCGAGGTCACAGATTCCGTCTGAGATGGGAGGCGCTGGGGAACTGGGGGCTCCAGT CCTGGTATGAGACTCTCAACAGCAACATCAGCTTTTTCTTTCGTAACAGAGCATT | SEQ ID NO: 1848 |
| AAK1 | ADXCRPDRC.17316.C1_at | AGGTGGGCACTCTAGAAACAGCAGTGGGAGCTCTGAGTCCAGTCTTCCCAACCTAGCCAGGT CTTTACTGCTGGTGGATCAGCTCATAGACCTGTAGCCGTGACCCAGTAGCAGATGCAGTTCT GTAACCTTCATACCGTAAAATACATTTTCATTACGGAGTTATG | SEQ ID NO: 2036 |

TABLE 8-continued

Genes and corresponding Almac probesets predicting resistance to 5-FU. There can be multiple Almac IDs/probesets associated with a given gene.

| Gene | Almac Probe ID | Probe Sequence | SEQ ID NO |
|---|---|---|---|
| AAK1 | RDCR092_B07_s_at | AACTCCCTCTGCTGACTATTTGGAATGGACTGAATGAGGAGGTCTCTCCAGCCAGAAGGAGT ATTGAGGTCATCAGGCCTCAGAAAACAATGTACACATAATCTCGGGCTGTGAACAAGAGAAA GGAGGGGGGGAAACATGAAAGTCAATCTTAACAATTTTTGCAATACCTCTTATTTGCAGACC ATTGGATTTATGTTATTGCACTCTCGGTGTGATTTATCGTATGTATCTGAT | SEQ ID NO: 1363 |

TABLE 9

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| ANP32B | ADXCRIH.2787.C1_s_at | ACATTCCGCCTTCCTTCCATGTAGTCCCTCTTGGTAATCTACCACCAAGCTTGTGGACTTCAC TCCAACAAAATTGTAAGCGTTGTTAGGTTTTTGTGTAAGATTCTTGCTGTAGCGTGGATAGCT GTGATTGGTGAGTCAACCGTCTGTGGCTACCAGTTACACTGAGATTGTAACAGCATTTTTACT TTCT | SEQ ID NO: 1143 |
| ANP32E | ADXCRAG_AL832674_s_at | CTGTGCAATCAAAATTAGAGTACTTTGGTTTGAAAACAACACTTAGAGCCTCCAGATAACTTT TAAGACTTATTTAGCTTTGTGGGTGGTATTTTCATGCAAATAAGTAAGGGTGGGTTTTATATT TTGTAGAAGTTTTCGGTCCTATTTTAATGCTCTTTGTATGGCAGTATGTATATATTGTGTTAA GTTCCTCAAGAATCTCCTTAAAAACTTTGAAGTTAATACTTTTGTGCAACTGTGTTTTGAATA AAGCCATGACAGTGTTAAAA | SEQ ID NO: 896 |
| ANP32E | ADXCRAG_AY057381_s_at | TAATGTTTCTGGGTGTGCAATAGAGTGATCACATCTTTGTTTCTTCATGTACGATAGCTATCC CTACGAAGATAATGTGTAACTTTTTATAGGAAAAGTGTGGTTTTACTATTTTTGCCTTATCA TTCCAAATAAGAACTAGTCTGTTAATGATCATATTGTATGTAGAGAAAAATTTTCATTGACTC CCATTGTGGAATTCCCTAGCAATTTATTTAGACTTAATTTTTTAAATTCAAGCTTACTGTATT AGT | SEQ ID NO: 902 |
| ANP32E | ADXCRPD.6256.C1_at | AATGTTTTAAGACGGCTCCCTCCAGTTACCCGGTAGGAAGACTTTCTGGCCGAAAATTCTTTG AAAAAATACTTGGAAAAAGGTCCCTCTCGCCCCCCGCTTTTAAACTGGTGGGAGGGAGTCCCCC AAACCCCCTGGTGAAACGATCCTCTAGCCATTAAAACGTTCATTTCTTCTGAAAACTTCACCT GGCCGGCCCATTATTTGCCAATAACCTCTTAAGAGTGGTGAATCTTTTGGGCACCCAGGGAGC GGGGAATAAATTGTGAAGGACCGCCTCGCGG | SEQ ID NO: 1732 |
| ANP32E | ADXCRAD_CN391960_at | AAAATTTGCAGTACTCCTGATTATTCTTTTATTGTTTTTGGACTGTTCCCTGTTTTTTCTGTG ACTGCTGTAACTTAAAGTTTTTG | SEQ ID NO: 2691 |
| ANP32E | ADXCRAD_AI697657_s_at | GCAATTCCTTTATGATCACCTTCCCTTCTTGTTTCACTCCCTCCCGCTCTCTCAAAAGGAACT TGGGAAACTTGTGAAACCCAGGAAAACCTTTAGTCTTATACCTCAACTACCTTTCAGTCCTGT CTGGGTTTTAAATAAGTGAAGTAGAAGAAATTGAGTATTTTCTGACATAAGAATATATTATCA ATACAGTTTTATGCAGTAAGCTCTCCTTACCATANATGTTTCTTGGTTGACAACATCTAAGAC AATATT | SEQ ID NO: 2807 |
| ARHGAP15 | ADXCRPD.9769.C1_at | AAAAACATCTTCAGTGCTCCGGTGACAACGTGGATGTCCTCCCACTGGCTGTCGTCCAAATTC AGCTTCTCTTCAGTTTAATGAAGTGACAAATTATTGGCTTGCTCTGGAGGTCAAATGACCACT GTGAAAAATCTGCAGCTTACTAGGGGTGTCCACAGGTCTCCATCCAGTTCTGATAGAAGGGCT GGTATTCCAGAAACGACTTGGTTGACAATAAATCTTAACTTCTGTATTGTTGCCAGATTGCCA CTAACTCGATATATTCCATCAACATCTAGACCTC | SEQ ID NO: 1508 |
| ARHGAP15 | ADXCRPDRC.9769.C1_s_at | TACCCTTCTGCGAGCTGAAATGAAACAGGAAACATGGCGATCCACATGGTCTACCAGAACCA GATGCTGAGCTCATGCTGAGTGAGTACAGTAAGATCTTCGGCTCAGAGGAAGACTGACAGAC AAGACAAGCTACTGAATACGTTCACATCTGTCTTGATGCCTAATATTTTACATTTCTGTAAA CATATTTCTGAAATATTTTTTGCCTTTCAAGCGACAGATGCCTCATTTTGTGAA | SEQ ID NO: 1952 |
| ARHGAP15 | ADXCRAD_AI510829_at | GATAAATCTCACACACATACTTCCACTCATACCCACCACATGTATTATATTAGCAATATCATA CTCTAGGTCTTCTGGTTTGAGTCAGTATAACATGATAGGCACATTTCTATGGAATTTCATGCA TTATTTTCTTTTAATGCTTATGAGGGTAAGTACCAAAATATCCATTTTTCATTCACAGAGTAG AATTATTTTTTGACTTTTTTTGTGATCTTTTGACCAACTCTCACATCCAGAAAATGTGCCATT | SEQ ID NO: 2854 |
| ARHGAP19 | ADXCRAD_BE278749_s_at | GCCACAGCCTGTGCTAAAGAGCCATGGAGCCCTCCCCTGGCCATGTCTGGGGACAGATAGAAC CTGTTGGGGGAAATATTCCCTCACCCCAGGGTTCTTTCTGCAGAGCAAGGGTTGCCTTTGTCC TATCCCTGAGCTTGCTCAACAAGAGAAACAAGGTTTCTTAAGTGTTTTGGTTAAAGTTTTCAT TCTTATTTGACTATGTATATGTAATTGTAAAGAAACGATCCTATGCATTGTCTTTCT | SEQ ID NO: 2729 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| ARHGEF6 | ADXCRAD_BM694731_s_at | GATGAGTACATATGCATGTTTCGGGGACTTGGCCCTTCTGATGAGGGGCCCTCGGTACTCTGG ATAACGAAGCTTGTGCAGAGTGGTAACCATGCTTACACACTAAACTATAATATAAAGGAAATG AAGCCATGTTAATCTGAGAGCAGTGTCGCCATAGTTGTGTTGTTTACAATACTCTATAAATGG GTTCCTGTTGCCCTGTAATTAAACTGCTGCCCGTAGAGGCCTTTCAGTTCCTTTTCTGTCCTT CCCCTTCTTAACACAAGCTCAAA | SEQ ID NO: 956 |
| ATF3 | ADXCRAG_AB066567_s_at | AGCCGGCCCGCCTGAGAGACACTAGGGGAAATAGCTTTTGTGGGCAAGCAGGGTGGCCGGTGG TGCTCAGCAGTCTTTCCAGTGGCTGTGTCCCTCCTCCAAATGTGGACAGGCCATGACAGAGTC TTAGCCCAAGTCCCACAGATCCCCAAAAGTTCTGTTGATTGCTTCAGGGGATCAGTGAAAATT AGGGAATTTTGTGTGTTGCTATATACATTTTTTCTGGGGAGATGAGCTTCTCATTGAGATCTG TGACTCAGAATCGACTAAGCCACCATAAGTCTGGATT | SEQ ID NO: 841 |
| ATF3 | ADXCRAG_AY426987_at | CGTGAACAGCGTTTCCAATTAGAATCTGCCTGAAAGGAGGTCCCATTTGCCCACTGAGCATCC TGTGTTCTCATGGTGGCTCTAACTCCAGAAGATTTTAACACAGTCTCATCAAACACTGCTTTC AGGGAGGAATTTACACTGAGGTTAAAAGGACTGTTGAGGACTAATGCTAACAGAAGCTAACAT TTATTGCGTAGGACAATACACTAAACACTTCACATGTATTATCCCA | SEQ ID NO: 909 |
| ATF3 | ADXCRPD.13867.C1_at | TTAGCAAAACCCTCAAACACCAGTGACCCAGGAGGGGACAGGCAGGGGACGATGGCAGAAGCA CTCACTTCCGAGGCAGAGACTGGCCTGGGTGTTGAAGCATCATTTTGCTCCAGGCTCCGCTC GGGGCGGCCAGGGTCGGGACGGGGTCGGGCGGGCTGTTTGTCTGGCCGGCGGGCGAGCACACG AGGACTCACGGCCGGCGCGCGGGCTGAAGGGTGCGCTCGGGCGGCGGCGAGAGAAGAGAGCTG TGCAGTGCGCGCCTGGCTGCGATCCCGGGAATT | SEQ ID NO: 1712 |
| ATF3 | ADXCRPD.1294.C1_s_at | GTGGTACCCAGGCTTTAGCATTATTGGATGTCAATAGCATTGTTTTTGTCATGTAGCTGTTTT AAGAAATCTGGCCCAGGGTGTTTGCAGCTGTGAGAGTCACTCACACTGGCCACAAGGACGCT GGCTACTGTCTATTAAAATTCTGATGTTTCTGTGAAATTCTCAGAGTGTTTAATTGTACTCAA TGGTATCATTACAATTTTCTGTAAGAGAAAATATTACTTATTTATCCTAGTATTCCTAACCTG TCAG | SEQ ID NO: 1882 |
| ATF3 | ADXCRPDRC.13867.C1_s_at | TGTACCTCTAGAATCCCAGCAGCAGAGAACCATCAAGGCGGGAGGGCCTGCAGTGATTCAGCA GGCCCTTCCCATTCTGCCCCAGAGTGGGTCTTGGACCAGGGCAAGTGCATCTTTGCCTCAACT CCAGGATTTAGGCCTTAACACTGGCCATTCTTATGTTCCAGATGGCCCCAGCTGGTGTCCT GCCCGCCTTTCATCTGGATTCTACAAAAACCAGGATGCCCACCGTTAGGATTCAGGCAGCAGT GTCTGTACC | SEQ ID NO: 2007 |
| ATF3 | ADXCRAD_AB078026_s_at | GAATGCTGAACTGAAGGCTCAGATTGAGGAGCTCAAGAACGAGAAGCAGCATTTGATATACAT GCTCAACCTTCATCGGCCCACGTGTATTGTCCGGGCTCAGAATGGGAGGACTCCAGAAGATGA GAGAAACCTCTTTATCCAACAGATAAAAGAAGGAACATTGCAGAGCTAA | SEQ ID NO: 2779 |
| BATF | ADXCRPD.6100.C1_at | CACACAGACTGTGGCAGAACTGCGCCCCATCCCGCAGAGGCCCCCTGTCCACCTGGAGACCCG GAGACAGAGGCCTGGACAAGGAGTGAACACGGGAACTGTCACCACTGGAAAGGCGTGAAGCCT CCCAACAGTGCCGCAGCGTTTCGAGGGGCGTGTGCTGGACCCCACCACTGTGGGTTGCAGGCC CAATGCAGAAGAGTATTAAGAAAGATGCTCAAGTCCCATGGCACAGAGCAAGGCG | SEQ ID NO: 1716 |
| BCAT1 | ADXCRAG_AL390172_s_at | AATTTCTTTGTGGCAGTCATTTATTAAGGATTCAACTCGTGATACACCAAAAGAAGAGTTGA CTTCAGAGATGTGTTCCATGCTCTCTAGCACAGGAATGAATAAATTTATAACACCTGCTTTAG CCTTTGTTTTCAAAAGCACAAAGAAAAGTGAAAGGGAAAGAGAAACAAGTGACCGAGAAGTC TTGTTAAGGAATCAGGTT | SEQ ID NO: 890 |
| BCAT1 | ADXCRPD.1208.C1_at | TAAAAACAGTGGGTTGAGCCCCAGCTCCATGTATTAGGTAGCTAGGTATATTGTGGGATTATT CCTTGTTAAGTCACCCCAGGAAACATTTGCAGAATTTAGAAATGCATCCAGATTTGTGAGTTT ATTTTTAAGACCTGACTAAAAATCTGCACTCTTCAAAAACTTATTGATGAAGTACAAATTGAG GCAGAAATTTACATTCCTTTGCTTAATCCCTGAGAATGAGTATAATGATCATAGAACTAGTTC GAGAGACTGCAATGTGTCCAGACTACTGTCAGACC | SEQ ID NO: 1878 |
| BCAT1 | ADXCRAD_BU953528_at | TATTTGCAGATTCCTCATCAAATCTGTAATTATGCACAGTTTTCTGTTATCAATAAAACAAAA GAATCCCAAANNNNNANNNNNNNANAAAAAAAAANNAACATGTCCGGCCGCCCTCGGCCCTCGA AGAAACTTTCTAGGAACCTTCGTTTTGGGCGCGCGGGCCCCAGTTAAGGTAGGTGAACATGG | SEQ ID NO: 2413 |
| BCAT1 | ADXCRAD_BU953528_x_at | TATTTGCAGATTCCTCATCAAATCTGTAATTATGCACAGTTTTCTGTTATCAATAAAACAAAA GAATCCCAAANNNNNANNNNNNNANAAAAAAAAANNAACATGTCCGGCCGCCCTCGGCCCTCGA AGAAACTTTCTAGGAACCTTCGTTTTGGGCGCGCGGGCCCCAGTTAAGGTAGGTGAACATGGG GCCATAGCTGGTTTCCCTAGGGAGAACCCTGGGCCATGAACTA | SEQ ID NO: 2414 |
| BCAT1 | ADXCRAD_BG393815_at | CTCAAAAGATTGTCGTAAGAACAACAATGTCAAGACCAAAAAA | SEQ ID NO: 2431 |
| BCAT1 | ADXCRAD_BM472661_at | TTCCTCCATGATTTTAGTGGCCTCCTTTTGTACTTCACTCAGATACTAAATAGTAGGTTATTC CTTTATATAAGGTACATTTCTGCTCC | SEQ ID NO: 2671 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| BCAT1 | ADXCRAD_BM472661_x_at | GAGTGATTGTTTCTTCATGCCAGAGAANATGAATTGCAATCATCAAATGGTGTTTCATAACTT GGTAGTAGTAACTTACCTTACCTTACCTAGAAAAATATTAATGTAAGCCATATAACATGGGAT TTTCCTCCATGATTTTAGTGGCCTCCTTTTGTACTTCACTCAGATACTAAATAGTAGGTTATT CCTTTATATAAGGTACATTTCTGCTCCTCAAACAAAT | SEQ ID NO: 2672 |
| BIRC3 | ADXCRPD.2751.C1_at | GTGTTATATGAGCATGATTTGGTAACTTCAGG | SEQ ID NO: 1557 |
| BIRC3 | ADXCRPD.2751.C1_s_at | TTAATCCGGAAGAATAGAATGGCACTTTTTCAACATTTGACTTGTGTAATTCCAATCCTGGAT AGTCTACTAACTGCCGGAATTATTAATGAACAAGAACATGATGTTATTAAACAGAAGACACAG ACGTCTTTACAAGCAAGAGAACTGATTGATACGATTTTAGTAAAAGGAAATATTGCAGCCACT GTATTCAGAAACTCTCTGCAAGAAGCTGAAGCTGTGTTATATGAGCA | SEQ ID NO: 1558 |
| BIRC3 | ADXCRPD.793.C1_at | TGACACATTAAAATACTTCTACAGTGACAAAGAAAAATCAAGAACAAAGCTTTTTGATATGTG CAACAAATTTAGAGGAAGTAAAAAGATAAATGTGATGATTGGTCAAGAAATTATCCAGTTATT TACAAGGCCACTGATATT | SEQ ID NO: 1608 |
| BIRC3 | ADXCRPD.793.C1_x_at | TGACACATTAAAATACTTCTACAGTGACAAAGAAAAATCAAGAACAAAGCTTTTTGATATGTG CAACAAATTTAGAGGAAGTAAAAAGATAAATGTGATGATTGGTCAAGAAATTATCCAGTTATT TACAAGGCCACTGATATTTTAAACGTCCCA | SEQ ID NO: 1609 |
| BIRC3 | ADXCRPD.1900.C1_at | ATGAACATTTAGGGACTGTGGTTTTTATAAAGAATTCGGGGAGAAAAATTTATAAGGCCACGA CCCGGGNTTAACAGAAAAGGNAAAAAACTGGTTGGCGCCTTCGGGCCTCAAGAGGTT | SEQ ID NO: 2273 |
| BIRC3 | ADXCRPD.1900.C1_x_at | GGGACCATTTCTCTGTCTTTTTTGATCAGGGCCTATACATCGAAGGTGTGCATATATGNTGAA TGAACATTTAGGGACTGTGGTTTTTATAAAGAATTCGGGGAGAAAAATTTATAAGGCCACGAC CGGGGNTTAACAGAAAAGGNAAAAAACTGGTTGGCGCCTTCGGGCCTCAAGAGGTT | SEQ ID NO: 2274 |
| BIRC3 | ADXCRPD.1900.C2_s_at | TCCTTCCCATAAGATGCTTCTTCATTGCCACTTGTAGAACACGGGGGTCAACCCATCATAAAA TCTATTATGGAATGCCTGAGACAAGAATCAAACAGTCCCTTTAGTAAGTTTGTTTATTCACTT CTCTATTGATTCATTCAAGAAGTCTCATGCCAGCCCCACCTATTGGAAGAAGGTCTGAGTTTT ATTCTTATCTCTTTGGTATTAATTCTGAAACTTAGAAAGTACACTGGTTAGCAATGCTTGGGA CCAACAG | SEQ ID NO: 2275 |
| BIRC3 | ADXCRAD_U37546_x_at | TATTTTGGCATTGTACTAATACCTGGTTTTTTTTTGTTTTGTTTTTTTGTACAGACAGGGCA GCATACTGAGACCCTGCCTTTAAAAACAAACAGAACAAAACAAAACACCAGGGACACATTTC TCTGTCTTTTTTGATCAGTGTCCTATACATCGAAGGTGTGCATATATGTTGAATGACATTTTA GGGACATGGTGTTTT | SEQ ID NO: 2814 |
| BIRC3 | ADXCRAD_AA805622_at | GTGCCTACTATTTAAATACCCTATACCTGAGTTACAAATCACCTAAGCACAATTACAAATAAT TCAGCCTAGCACCCATGCAGGACACTGGCTAGTACATGGGTAGCCAGCAGAGCCTCTTAGCAG AGGCAAAATCAATTGCATTTCAAGGAAATAAGTCTCCCAGCATCAGAATGCAGAGATGGATTC TTTCCTCCCCTCACTTGGTCCCTAATTGTTCTCTT | SEQ ID NO: 2860 |
| C1orf114 | ADXCRAG_BC026073_s_at | GTAGAGTAAGTAAAACTTCTCTGAAAAATAAGTTCATACAGATATGAAAGCTGAACTTATTTA TAGAAGGGAGTCTGGATATCAGACTAACAGCCTATGGAAGAAGTAGAAAAGTTGGTTCAAGAAC TACCCTTGCAAAAGATGCAACATGCAGATAACTACAATTAGGTTCTAAGAGGTCTTGTGAAAA TAAAATGATTCCTATTTTGTTCAGACTTTGATGGAACAG | SEQ ID NO: 951 |
| CBFB | ADXCRIH.116.C1_at | TTTGTAAGGAGGTGCCAAATGACTTAGCACTGTTTTCCACTCTGTATCTNNNNNNNNNGTTGC AATTTGACAGTAAGCCTATTTAAAAAATATTCTTACATTAATTCATCTCAAAAGGTTCTATTA ATAGTCCTTTTGCAAAATACCATATATATAACTGTGAACGTTTTTTCCAGAATTAATGGAAGA AAATGCATCCTCTGCACAGATGAACATTTTCTCT | SEQ ID NO: 1283 |
| CBFB | ADXCRIH.116.C1_x_at | GAGGTGCCAAATGACTTAGCACTGTTTTCCACTCTGTATCTNNNNNNNNNGTTGCAATTTGAC AGTAAGCCTATTTAAAAAATATTCTTACATTAATTCATCTCAAAAGGTTCTATTAATAGTCCT TTTGCAAAATACCATATATATAACTGTGAACGTTTTTTCCAGAATTAATGGAAGAAATGCAT CCTCTGCACAGATGAACATTTTCTCTAAAACCCTCGTG | SEQ ID NO: 1284 |
| CBFB | ADXCRAD_AL557216_s_at | ATTTTTCTGTCATTTAGCACCATGCTGCTTCTGTCTGTCTTAATGCTGGCATTAAGATCATGA GCCCTTTTTCTCCAGTAGTACAGGCTTTGAAAACTACTTCTATTAAGTTATTGATGCAATTTG ATATTTTTTCATAATCTATATTTAAACAAAATTACATCATTGCATCATCTTTTCTAAATTCAT CTCCATTAAAACTTGCCTTAAGCTACCAGATTGCTTTTGCCACCATTGGCCATACTGTGTGTT T | SEQ ID NO: 1332 |
| CBFB | ADXCRAD_AL561208_at | TCTCAACCTTAGGCAGTAATAGACATCACAAACTGCCATGGTTTTGCACTATGATTATAATAC CTGCATTTCTAATTTTTAAGCATGTAGCCAGTAATAATTTGAAGTTTTTTTCTATGCAAGC TTACCTTGTTGGCATTATTTTTAGGGAGTTGAA | SEQ ID NO: 2455 |
| CBFB | ADXCRAD_AL561208_x_at | CTCAACCTTAGGCAGTAATAGACATCACAAACTGCCATGGTTTTGCACTATGATTATAATACC TGCATTTCTAATTTTTAAGCATGTAGCCAGTAATAATTTGAAGTTTTTTTTCTATGCAAGCT TACCTTGTTGGCATTATTTTTAGGGAGTTGAA | SEQ ID NO: 2456 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| CCDC109B | ADXCRAD_BM830891_at | GAGTAGGCAATTTCTTCAGTTCTTCCACAAGAAATCAAAGCAACAGCACTTTGATGTGCAGCA ATACAACAAGTTAAAAGAAGACCTTGCTAAGGCTAAAGAATCCCTGAAACAGGCGCGTCATTC TCTCTGTTTGCAAATGCAAGTAGAAGAACTCAATGAAAAGAATTAATCTTACAGTTTTAAATG TCGTCAGATTTTCCATTATGTATTGATTTTGCAACTTAGGATGTTTTTGAGTCCCATGGTTCA TTTTGATTGT | SEQ ID NO: 2712 |
| CD247 | ADXCRAD_NM_198053_at | AGAGGAGGCCGTTGATTCACTTCACGCTTTCAGCGAATGACAAAATCATCTTTGTGAAGGCCT CGCAGGAAGACCCAACACATGGGACCTATAACTGCCCAGCGGACAGTGGCAGGACAGGAAAAA CCCGTCAATGTACTAGGATACTGCTGCGTCATTACAGGGCACAGGCCATGGATGGAAAACGCT CTCTGCTCTGCTTTTTTTCTACTGTTTTAATTTATACTGGCATGCTAAAGCCTTCCTATTTTG CATAA | SEQ ID NO: 2773 |
| CD3D | ADXCRAG_BC039035_at | AAAAATAGATGTTGGGTCTCGTCAAGTGCTTACCCTGCATCCATTGAGATGATAATATGGTTT TACTTTTTTAGTCTGTTAATATGGTACATTACATTGATGGCACGATATGTTAAACCAACCT | SEQ ID NO: 959 |
| CD3D | ADXCRAG_BC039035_x_at | AGTTCTTTTCTTTCTAGTTTGCTGAGAATTTTTATCAAAAATAGATGTTGGGTCTCGTCAAGT GCTTACCCTGCATCCATTGAGATGATAATATGGTTTTACTTTTTTAGTCTGTTAATATGGTAC ATTACATTGATGGCACGATATGTTAAACCAACCTTTCATTCCTGAAAAAAACTCTAGTCATTT GGTATTATTCT | SEQ ID NO: 960 |
| CD3D | ADXCRAD_BX457462_s_at | CGTGGCTGGCATCATTGTCACTGATGTCATTGCCACTCTGCTCCTTGCTTTGGGAGTCTTCTG CTTTGCTGGACATGAGACTGGAAGGCGTGTCTGGGGCTGCCGACACACAAGCTCTGTTGAGGAA TGACCAGGTCTATCAGCCCCTCCGAGATCGAGATGATGCTCAGTACAGCCACCTTGGAGGAAA CTGGGCTCGGAACAAGTGAACCTGAGACTGGTGGCTTCTAGAAGCAGCCATTACCAACTGTAC CTTCCCTTCTTGCTCAGCCAATAAAT | SEQ ID NO: 2553 |
| CD53 | ADXCRPD.1819.C1_at | GGTTGCTATGCGAAAGCAAGACTGTGGGTTCATTCCATTTTCCTNATATCGNGATCATCACCA TCTGTGTATGTGTGAATGAAGGTTTTGGGGATGTCCTTTTGCCCTGACCCTGAACTGNCAGAT TGACAAACCCAGCAGACCCATAGGGTATTGATCTGCAGNAANTCCTTGGGGTGGAAAGAAACT GGTTTCATCTTCGGGAATGCCAAACCATTTTATAGCATGGAGCCCCTACCTGT | SEQ ID NO: 1497 |
| CD53 | ADXCRPD.3701.C1_at | TGGACCATTGTCACAACCCTCTGTTTCTCTTTGACTAAGTGCCCTGGCTACAGGAATTACACA GTTCTCTTTCTCCAAAGGGCAAGATCTCATTTCAATTTCTTTATTAGAGGGCCTTATTGATGT GTTCTAAGTCTTTCCAGAAAAAAAACTATCCAGTGATTTATATCCTGATTTCAACCAGTCACTT AGCTGATAATCACAGTAA | SEQ ID NO: 1629 |
| CD53 | ADXCRAD_AW293276_at | TTGAACACTCAGTGCTGACCAGAGATTAACATAGGGCATGCAATACTAAAATTGGTTTGCATT TCACTTTCTGCTTCAACGTTCAGTAAATCCATCATAGCCCTACCAGGTGCCAGGGCAGTTGCT GGTCAGTGGTTGTCCTAGTCTTTCTCCACAAACCTGAAAACCCTGGAGATTTCCAAACCCCT TCAGGAGCAGATAACATGAGGAGACAAGACCTCAGGGATTCAGTCTAGTTGGAAGATAGTTGT GGCTTCTTCTCAGAGCCTATTCTGGAGGTCCAAAT | SEQ ID NO: 2849 |
| CD93 | ADXCRAG_NM_012072_at | TATGTGCCTATCCTAATAAACTCTTAAACACATT | SEQ ID NO: 1039 |
| CD93 | ADXCRAG_NM_012072_s_at | CAAATTTGTTTGACTAATTCTGGAATTACAAGATTTCTATGCAGGATTTACCTTCATCCTGTG CATGTTTCCCAAACTGTGAGGAGGGAAGGCTCAGAGATCGAGCTTCTCCTCTGAGTTCTAACA AAATGGTGCTTTGAGGGTCAGCCTTTAGGAAGGTGCAGCTTTGTTGTCCTTTGAGCTTT | SEQ ID NO: 1040 |
| CD93 | ADXCRPD.8173.C1_s_at | GCAGGTATTTTCTACGGGTGTTTGATGTTCCTGAAGTGGAAGCTGTGTGTTGGCGTGCCACGG TGGGGATTCGTGACTCTATAATGATTGTTACTCCCCCTCCCTTTTCAAATTCCAATGTGACC AATTCCGGATCAGGGTGTGAGGAGGCTGGGGCTAAGGGGCTCCCCTGAATATCTTCTCTGCTC ACTTCCACCATCTCAAGAGGAAAAGGTGAGTTGCTCATGCTGATTAGGATTGAA | SEQ ID NO: 1812 |
| CD93 | ADXCRAD_BU150433_at | ATTTCCATCACCTTTGAAACATAGCTTTTAGCTTGGGAAATCTGA | SEQ ID NO: 2743 |
| CD93 | ADXCRAD_BU150433_x_at | GATCATTAGGTACTTTTGTTTCAACCTTTATTCCTGTAAATATTTCTGTGAAAACTAGGAGAA CAGAGATGAGATTTGACAAAAAAAAATTGAATTAAAAATAACACAGTCTTTTTAAAACTAACA TAGGAAAAGCCTTTCCTATTATTNTCTCTTCTTAAGCTTCTCCATTGTCTAAATCAGGAAAAA CAGGAAAACACAGCTTTTCTAGCAGCTGCAAAAATGGTTTAATGCCCCCCTACATATTTCCAT CACCTTTGAAACATAGCTTTTAGCTTGGGAAATCTGA | SEQ ID NO: 2744 |
| CD99 | ADXCRIH.3577.C1_at | GTTGGCATTCCGGTGGCTCTCCATGTCCACCTCCCCTTGTTCTGCATTTTCTTTGAAGCATAG CTTCTTTTTCTGGTAAGCAATGAAGCTAGAGATGGCTCCAGCCACGGCGACCACGACAGCCCC CACAATCCCGGGGATCACGCCTGGGGCGTCGGCCTCTTCCCCTTCTTTCCTGTGGCTGCCTCC ACCATCACTGCCTCCTTTTCCTTCTCACCTGAAACGCCATCCGCAAGGTCAGCATCTGAAAA GCTACCGGAGGAACTAG | SEQ ID NO: 1223 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| CD99 | ADXCRIH.3577.C1_x_at | TTGGCATTCCGGTGGCTCTCCATGTCCACCTCCCCTTGTTCTGCATTTTCTTTGAAGCATAGC TTCTTTTTCTGGTAAGCAATGAAGCTAGAGATGGCTCCAGCCACGGCGACCACGACAGCCCCC ACAATCCCGGGGATCACGCCTGGGGCGTCGGCCTCTTCCCCTTCTTTCCTGTGGCTGCCTCCA CCATCACTGCCTCCTTTTCCTTCTCCACCTGAAACGCCATCCGCAAGGTCAGCATCTGAAAAG CTACCGGAGGAAC | SEQ ID NO: 1224 |
| CSDA | ADXCRIH.625.C1_s_at | GTTCATTTTGGATGCTGGTGCTAAACCTCCAAGTGTCATGATTTNNNNNNNNNNNNNNNTTTAT GTCCTTCTTATTTATTTCTAGGATGAGGGGAGGAAAACATTTTTGCTTTCTTATGTGACTCTC TTTGAAAATGTGC | SEQ ID NO: 1107 |
| CSDA | ADXCRSS.Hs#S1919678_at | TGCTGCACCGCCTACAAAATCAAATAAAGTTGATTATCCAACAGACAAAGGGAAGGCACACAC AACTCCTTTAGTTTATACTACTGTTTCTGATTACTAAACAGGTTCTGAAACTGTTTCTGATTA CTAAAACCAGGCTTAGTTAGGGACTTTTAGCATCAGTATTCCTAAGTGGTCACTAGTAGTTAA AACACTGCCTGTCTAGAAAAAAGAAGTTGAGTATCATCCACTCTGTCTGAATGCTTATACCCT CAACAAAGCTTATCAAAATGAGGTCAATCCCAGAAATA | SEQ ID NO: 2096 |
| CTCF | ADXCRAG_BC014267_s_at | AATCATGTAGCAGAATGGCACCCAGACCACTGCCCACCAGTGACGGACATGCACGTGGCAGAT CATGATTTCCAGCCCACGGAGCCAGCATTTGAACCTTGTATAATTAACTTTCAGTTATGATTT CCCATCGACATTTTCTTTGCCCTGTTTGTAGCTGATTGTTGTGTTTTATAAATCTTCTGTTAA GGCAGAAGGGTGATTATGAGTGGTTCACAGCAGCCCTTATAAGCTGGGCCAGAAAATTTCACT AGGTCAG | SEQ ID NO: 939 |
| CTCF | ADXCRPD.12254.C1_at | GAGGGCATAGCGCTCATGAAACACAGCATCACAGTAACGGCATTTCTTGCCTTGCCCAATATA GGAATGCTGCTTTCGCAAGTGGACACCCAAATCACTTTTTCGGGCTATGACTGTGTCACAGTG GGGACAGTGAAGTTTGGCCGCATTTTCTGTGTGCTTCTGTAAAATGTGCATCTTCATGGTACC ACTTTGGGTAAACCGAGCATGACAAATATAACATTCATAAGGCTTTTCCCCTGAATGGGTTCT CATGTGCCTTTTCAGCTTGTATGTGTCCCGCTGGACTACAGCA | SEQ ID NO: 1545 |
| CTCF | ADXCRPDRC.12254.C1_s_at | GTCACACAAGAATGAGAAGCGCTTTAAGTGTGACCAGTGTGATTACGCTTGTAGACAGGAGAG GCACATGATCATGCACAAGCGCACCCACACCGGGGAGAAGCCTTACGCCTGCAGCCACTGCGA TAAGACCTTCCGCCAGAAGCAGCTTCTCGACATGCACTTCAAGCGCTATCACGACCCCAACTT CGTCCCTGCGGCTTTTGTCTGTTCTAAGTGTG | SEQ ID NO: 1961 |
| CTCF | ADXCRAD_CB164277_at | TAAAAAGTGATTCTTGCACATGAACTGTCACATGTTTAAAAATGTGTTTTTAGAGAGCCTCA GTCTTACTGATTTCAAACACTTTTTTCTTCTGTGTATTGCTTTTAAGAGAGCCATCAGTTAGC TATCAGACTCTAGGTTGATGCATTTTGTACTTAGCTGTACTGTGTGATATTTTCATTATTTT AGGACGCCAACATGAGACCTGTAATAAAAATATGTAATGGGGTTGAAAGCTGGGGAGGAGGATC TACTGCTACAGCTAATAAATCATAACGGAT | SEQ ID NO: 2395 |
| CUTC | ADXCRPD.14073.C1_at | TTCTACTGGCTTCACATTAACAATAATTTTNGTTGAATTTGAATTCTTAAAAATCTACTGACA ACATTTAAGTC | SEQ ID NO: 1642 |
| CUTC | ADXCRPD.14073.C1_s_at | TCCTGAAGTACATGCCATGTACTCCCCCTTTATTTCTACCTTGGATCAATGGCCTCTGCGGAG TGTAGTGAAAGACATCTTTTTATTATGATCTACACTTTAAAAAACCAAAGGCTGCCTGTATTA CA | SEQ ID NO: 1643 |
| CUTC | ADXCRPD.14073.C1_x_at | CTCAATCCAAAATTACCCTTAAGTGGAAGTCCTGAAGTACATGCCATGTACTCCCCCTTTATT TCTACCTTGGATCAATGGCCTCTGCGGAGTGTAGTGAAAGACATCTTTTTATTATGATCTACA CTTTAAAAAACCAAAGGCTGCCTGTATTACATTTGCTTTGGGGAGTTGTTAAGACTCTGTTTT TTCTACTGGCTTCACATTAACAATAATTTTNGTTGAATTTGAATTCTTAAAAATCTACTGACA ACATTTAAGTCAGTGTGAGGAA | SEQ ID NO: 1644 |
| CUTC | ADXCRPDRC.2453.C1_at | ACAGATGTGACCAAAGTAAGGACTTTGAATGCTATCGCAAAGAACATCCTGGTGTAGCCAGAC CTCTCTGAGAGACATGGATATCACAGGGATGAAGGTAGAACTATAATCTGCAATTCTCTATGA CACAGCTTTAACCTTCTTCTCTGGCCAGGACAGTCGCAATCCTTTGNTTTTAATTTTCACATG GGCCATGGGAGAATGTGGCCCAAAGAAAAGAAAAAGAAATTTGGAAACAGGAGATACAGGTCAC TTTCCTTTTTGCTTAGTCCTTAACCAGTG | SEQ ID NO: 1945 |
| CUTC | ADXCRPDRC.2453.C1_s_at | TGCTATCGCAAAGAACATCCTGGTGTAGCCAGACCTCTCTGAGAGACATGGATATCACAGGGA TGAAGGTAGAACTATAATCTGCAATTCTCTATGACACAGCTTTAACCTTCTTCTCTG | SEQ ID NO: 1946 |
| CXorf57 | ADXCRAD_NM_018015_s_at | ATCTGATTCCAGTTAAGCTATAAACTTGTGGGATTTTCTTGTAGCCCTATAGTTCTGTGACTT CATTTGCTATACGCTTTAAATGTGTTGAGCAGCCTATGAACCTAAAGACATACTGCAGTTTGT TCATAAATGTATTCAGTCTTTTATTCTTTATAATTGTGTGTAAATGTTAACTAAACAGTGGAT TCCTCTCGTGTTACAGTTTTGAGTGAA | SEQ ID NO: 2774 |
| CYFIP2 | ADXCRAG_AF132197_s_at | TGGGAATTTTGTACAATGAATTTACATTTATTTATGGTGACATATTTACGCTTGTGATCAAA TAATGATGTTAAATTCTTAAATCATATTTGCTATGCAGCTGAAGATGATATTTGA | SEQ ID NO: 863 |
| CYFIP2 | ADXCRAG_AF132197_x_at | TTTCAGAAACTGTCAAATGTACCATATTTGTATTAAGAGTTGTTGGGAATTTTGTACAATGA ATTTACATTTATTTATGGTGACATATTTACGCTTGTGATCAAATAATGATGTTAAATTCTTAA | SEQ ID NO: |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| | | ATCATATTTGCTATGCAGCTGAAGATGATATTTTGATTTGTATTTTGGGGGTACCTGTGTTGA GTTGATAAACATTTCCATCTTCATTAAAACTGCTTCCAAACTAAA | 864 |
| CYFIP2 | ADXCRAG_BC011762_s_at | AGACAGACAGTTCCACTGTGGAGCATGTGCGCTGCTTCCAGCCACCCATCCACCAGTCCTTGG CCACCACTTGCTAAGCAGAAGATCCTGCAGACCCTTATCTGGAGGAGGAAGAGAAGCAGGAGA GAGAAAGCCACAGCCAGCCTGCCATAGGATCCAACTGGACAACGTGTGGGATGGACCTGGAAA CAAGCACCTCCCCAAACACATCCACCACTCCCTAGGGCGGGGCCTGTGCATGCTCTCCCATGAC ATCTCCATGCTGGTTTCTCCATAGCATAAATG | SEQ ID NO: 932 |
| CYFIP2 | ADXCRPD.9810.C1_s_at | CCATGCCGAGCGCAGGAAGGACTTTGTCTCTGAGGCCTACCTCCTGACCCTTGGCAAGTTCAT CAACATGTTTGCTGTCCTGGATGAGCTAAAGAACATGAAGTGCAGCGTCAAGAATGACCACTC TGCCTACAAGAGGGCAGCACAGTT | SEQ ID NO: 1540 |
| CYFIP2 | ADXCRSS.Hs#S2524484_at | GGCTCAGTGCGCACAACTAGCTAGAGGCACTGACTTTGTAAGCAACAACACTATCTTCTTGAG GTCTAATAATTGCCTTGGCAAAGGGCAGCCAATGCCAACGAGGAACCCTGTGTACACAAGTTT CTCATCCCGAAAGTTGGACACTGGGTGCTCAAAAAATGCCTTCTGGTGACAGTAACACCTGACC AGTCAAACAAACATGCACGCA | SEQ ID NO: 2071 |
| CYFIP2 | ADXCRSS.Hs#S3733207_at | GCCTATGTTGTAGAATCCCTCGTACCCAGAGTGGGAGAAGATTACACCCGGGGCACTGCAGGG AGGGAACCAGGAGAGATGAAGTAGTAAGCTGAGGCATGCCCTTCTGGCCAGGCTGGCGTCTCT GGGCATGGCCACATCTGTTCACAGTCTGAGACTTGAGTCCTGGGGTCACACAAGGGCACTGGG TAGGAGATGTCTATCTTGGGAGGAGGTCTTGGGAAGCAACCACAGATAG | SEQ ID NO: 2161 |
| CYFIP2 | ADXCRAD_AV725374_at | GATATTTTGAATTGTATCTTGCGGGTCCCTGTGTTGAAGTGATAAACATTTGCATCTTATTAA AACTGCTTTCACACTTGTAGACCCCACAACTTACAACAATTAATTGGCCGTTGTTTTACAACG GCTGACTGGGAAACCCTTGCCGTCCCCAACTTTATTGCTTGT | SEQ ID NO: 2591 |
| DDX23 | ADXCRIH.3762.C1_at | TGAGGAAGGTGATGGCCACCCCACTCTTGCCTGCTCGTCCCGTGCGGCCAATGCGGTGGATGT AATCTTCAATATTTTTGGCCATATCATAGTTGACAACCATAGACACATCTTGGATGTCAATAC CACGACCAGCCACATCTGTAGCCACCAAAATATCCTTGGCCCCAGCCTTGAGGTTGGACAACG CAAACTCTCGCTGCTCCTGGCCTTTTCCACCGTGCAGTGTGCAAGCATTGTACCCCATCTTCT CCAGGGATTTGGCCAACACGTCGCAGC | SEQ ID NO: 1145 |
| DDX23 | ADXCRPD.1564.C1_s_at | TGGCACCATGAGGATTACAGACAGTGGAATCTTACTGTCATCTGGACAGCTGTTTTCCTGTTT GGATGGTAAAGGAAGTTGAGAGTCTTTAGACCTGTGCACAGCCCCACACCAAGGGGTGCTGTA TGCTCTAGGCATCCCCTCCCCCAGGGGATTTTCTAAGTAGATGGGGGGACACGGTGAACTGGC TGTGTCCATCTTTGTCACTGAGTGAAATCTCTGTTTTCTATTCTGAGAAGATAAGTTTGTA TGTTCTGAGAATA | SEQ ID NO: 1441 |
| DDX23 | ADXCRPD.15034.C1_s_at | GAAGGACCGAGATCGAGACAAGGATGGGCACAGACGGGACAAGGACCGTAAACGATCCAGCTT ATCTCCTGGTCGAGGAAAAGACTTTAAATCTCGGAAGGACAGAGACTCTAAGAAGGATGAAGA GGATGAACATGGTGATAAGAAGCCTAAGGCCCAGCCATTATCCCTGGAGGAGCTTCTGGCCAA GAAAAAGGCTGAGGAAGAAGCTGAGGCTAAGCCCAAGTTCCTCTCTAAAGCAGAACGAGAGGC TGAAGCTCTAAAGCGACGGCAGCAG | SEQ ID NO: 1698 |
| DOCK2 | ADXCRAD_NM_004946_at | GTAGATTCCTGAACTCAAGGTACCAGCAAGAATGCCTTCTCCCAGTGTGCTCTCCCCAACATC CTAGGCACAGCTTTCATAACCCAGTTTCTTAGGTGTAAGAAACTGCTTTTATCTCATTATTA AGTCTCAGAACTTAACAGAAAAGGAAGCCTTTTAAATATTCTTTTTAATTTTATTTTAGATTA ACAGTTTTGTACTTTACATTTTTTATACAACCAACCAGTTTCTTTTCTAGCCAATCATCTCT GAAGAGTTGCTGTTTCTTACTGACAAT | SEQ ID NO: 2777 |
| DPY19L1 | RDCR162_A06_s_at | AGATGTAGTTCTCCGTAGGCAGCAGGTCATGTAGCAGTCATTCTTTTACAACTTCTAGGACTT TGTAAACACTGTTCTGGAATACAGTGGTGAAGTGAGGTTTGGAATTCTTCACTAAGAGGTTAC ATAAGGGAGTTTTCCCAGCATTGGCAGGATCTTCTACATCTCAAATTTCAGCATACTGCAACC AGGCTTGGATCTTCTTACACACCATGACTCTTCTAGAATGTAATAGTTCACTTTTAACTTTAT CAGTTCTCGCTTCACTTCTTCGGCTGCTTTCCGACTATACATTGA | SEQ ID NO: 1358 |
| DPY19L1 | ADXCRPD.17046.C1_at | AAAAATGACTTACACCTTTATCAATTGGTTACTATTTCAATGCACCCTTTAA | SEQ ID NO: 1786 |
| DPY19L1 | ADXCRPD.17046.C1_s_at | TGGTGAAGGATTCCAAACCTCACTTCACCACTGTATTCCAGAACAGTGTTTACAAAGTCCTAG AAGTTGTAAAAGAATGACTGCTACATGACCTGCTGCCTACGAGAACTACATCTGTAATGGTT TTAATGTTTTGCTAAGTCATGTGTTGTTCATATCCCAAAAACTTTTATAGGTAACTGTTTTCA AATAGA | SEQ ID NO: 1787 |
| DPY19L1 | ADXCRPD.10268.C1_s_at | TTTTTGCTTTAGTATGAGGAAAGTAAGGATGGGCAAGAAGCGATCAAAATAGCTATTGCTAC AACATTNNNNNNNNNNNNNNNNNNNNNNNNNNNNNNNNNNNNNNNNNCTAAAATGCTT GGCAAAAAAAATATAGTGTTAAAATAGGCCAGTGATATTAATGAGAAAATGAAGTATGTATC AGGAATAAAGTGATATTGCATAGGAGTATTGTATTTTTATGAAT | SEQ ID NO: 1880 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| DPY19L1 | ADXCRAD_BU607292_at | TATTGCTACAACATTTTCGAAAACAAAGTTGGGGCTGTATTTCTTTAAAAAGATAAGCCTCTA AAAATGCTTGGCAAAAAAAATATAGTGTTAAAATAGGCCAGTGATATTAATGAGAAAATGAAA GTATGTATCAGGAATAAAGTGATATTGCATAGGAGTATTGTATTTTTATGAATTTTATGCCAG TTGTTTACATGTACCCTCGTTCCGAA | SEQ ID NO: 2540 |
| DPY19L1 | ADXCRAD_BU607292_x_at | GTTTTGCATATTGTTAGCATTTACAAATATTTTTGCTTTAGTATGAGGAAAGTAAGGATGGGC AAAGAAGTGATCAAAATAGCTATTGCTACAACATTTTCGAAAACAAAGTTGGGGCTGTATTTC TTTAAAAAGATAAGCCTCTAAAAATGCTTGGCAAAAAAAATATAGTGTTAAAATAGGCCAGTG ATATTAATGAGAAAATGAAAGTATGTATCAGGAATAAAGTGATATTGCATAGGAGTATTGTAT TTTTATGAATTTTATGCCAGTTGTTTACATGTACCCTCGTTCCGAA | SEQ ID NO: 2541 |
| DPY19L1 | ADXCRAD_BF447983_at | GAATAAGGCCTCTGCTAGAGTCCCAAATAAAGGATTAATTATCCTAAAGAAAAAGCCCCAAAA TAATAATCTTTGGGATCAAAAGGATTCTACCATCAGCCTCATATAAGTGGAACACAATGTAGG AAGCTCTTTTCTCAACCTGCTTTCACTACTCCCAGATTCAAGTAAAGCCACAACCAATTTACA AGGCCCAGTACA | SEQ ID NO: 2870 |
| EIF1 | ADXCRAD_BP342358_s_at | GGAGCTTTTGGTGGTAGATCCCCTGGTGTCTCCAACCTGACTAGGTGGACAGAGCTCAAAGAG GCCCTCTTACCGCTAGCGAGGTGATAGGACATCTGGCTTGCCACAAAGGTCTGTTCGACCAGA CATAT | SEQ ID NO: 1279 |
| EIF1 | ADXCRAD_CX761856_s_at | GTTTGCCTGCAATGGTACTGTAATTGAGCATCCGGAATATGGAGAAGTAATTCAGCTACAGGG TGACCAACGCAAGAACATATGCCAGTTCCTCGTAGAGATTGGACTGGCTAAGGACGATCAGCT GAAGGTTCATGGGTTTTAAGTGCTTGTGGCTCACTGAAGCTTAAGTGAGGATTTCCTTGCAAT GAGTAGAATTTCCCTTCTCT | SEQ ID NO: 2529 |
| EIF4A1 | ADXCRIH.1587.C1_s_at | GAGGACTCTTCGAGACATTGAGACCTTCTACAACACCTCCATTGAGGAAATGCCCCTCAATGT TGCTGACCTCATCTGA | SEQ ID NO: 1208 |
| EIF4A1 | ADXCRPD.16013.C1_s_at | CTTGGCTCTCAGTTTTCTCAGAGTGAACATGCCTCGTAGCTTGGGTCCTATGGCAGGAGTGCA ATAGGACATGGATATGCATCACCTGTTCTATAAAACTGGTTGCTGGCTG | SEQ ID NO: 1748 |
| FAM129A | ADXCRAG_AB050477_s_at | GTGCAAAGGGCTTAGCTAAGTTATCGAGCTTAAAACCCGTCAATTAAACAAACATTATTTGAA CAGTTACTGCATGCCACGCACTGTGTTGGGCTTAGTAATAAAAAAAGAAAAGATAAGTGCTT GTTCTAGCATAAATTAAAAGGTCAAGGGAATTTAATCTGGAAGAGAACATATGCCAATTTTT AAACTATGACAGCTTTTTTTTTTCTCTTTTCCATTCAAATAGTCCTGGTTCATTCCCAGAAGGG CACAAA | SEQ ID NO: 838 |
| FAM129A | ADXCRAG_AL137572_s_at | TAATAATAGTATCAGTCGGTGCAACAGTTGGCAACATGTGCCTTCACACTTTACCATAAAGAG ACGGGTTTGAGGGTTTGCCTTCTAAAGTCTGCAACTTCAAGAAAAAAAAATCGACACTGTGGA TTGACTTTCCCGGTCACTATATAAAGCAAATAAACTTAAAACACTTTGTAACCATGTATTTAC TCTGCCAGGTGCCTATATTCCAATAAA | SEQ ID NO: 889 |
| FAM129A | ADXCRPD.3083.C1_s_at | TGAAGATAACATGGCCTTGCCCAGTGAAAGTGTGTCCAGCTTAACAGATCTAAAGCCCCCCAC AGGGTCAAACCAGGCCAGCCCTGCCAGGAGAGCTTCTGCCATTCTGCCAGGAGTTCTGGGTAG TGAGACCCTCAGTAACGAAGTATTCCAGGAGTCAGAGGAAGAGAAGCAGCCTGAGGTCCCTAG CTCGTTGGCCAAAGGAGAAAGCCTTTCTCTCCCTGG | SEQ ID NO: 1495 |
| FAM129A | ADXCRPD.13585.C1_at | ACACCTGGCCTTGGAGTCGCTTTTAAATCTCTTTTACACATCCTGTATTCCAGTCCGTAAATA AACAAATATTTTTTGCTTTCTCCATAGTATATCCAGATTCATTCAGGCCACAACATCTTTCA TTTGATGTACTCAAGTAAGTTCCCAACTGGTTTTTCTACTTCCCATGCTTACTC | SEQ ID NO: 1668 |
| FAM129A | ADXCRPD.14825.C1_at | GATACCTCAGCCATTAGCAAGCTCTGTCAGTTTTTTCTTTTCTTATGCCTGTCTTATTCTTT CTCTCTTGGTTTATGCTTCAGAGCACTTGAAAAACCAGTATCACTAAAATCTAATTTTTGTCA AATTATCTTCAAAAATTGTATGGCTCTTTTTATTGTATTGAGTGTCCCTTAACTCTCAGCATT TTTGTAGTTTGGCAGTAGACTTTCTGACATTCTCTCTTATTTCCATATCCCAGTGAAATCAT TGTTCCATTTCAGCTAGA | SEQ ID NO: 1759 |
| FHOD1 | ADXCRAG_AB041046_s_at | ATGACCTGGTGCAGGCACTGGGACTAAGCAAGGGTCCTGGCCTGGAGGTGTGAAGGTGCTGTA TCCCGGAAATCTATCTGGACCCTGGACTGCAGTGCAGGAGATGACAGAGTGAGGAGGGCCCAG AGCAGAATTCTGGCCCCAGAACTCTGTGCCCAGGAGCCATGCCTTGAGCAGTATTAGCCGTGT GTGATGCATGTGAGTGTGTGTATGTGTGTGTGTGCATGCATATGCATGTGCATGTGTGTG AGCTCCTTGAACGCACGGAGCA | SEQ ID NO: 837 |
| FHOD1 | ADXCRAD_BU522109_at | TGCGCGCCTCTTTCTTGTATCCTCACCCCGATTTGTTACGCCGCTACGCCGCCGCTTCTATAT TCCTTTTCATGCACCGCCTGGCGTCGCCTTTTGCGCGCCGACG | SEQ ID NO: 2584 |
| FSCN1 | ADXCRPD.10135.C1_at | CTGGGCACATGTCCCAAGCCTGTCAGTGGCCCTCCCTGGTGCACTGTCCCCGAAACCCCTGCT TGGGAAGGGAAGCTGTCGGGTGGGCTAGGACTGACCCTTGTGGTGTTTTTTGGGTGGTGGCT GGAAACAGCCCCTCTCCCACGTGGCAGAGGCTCAGCC | SEQ ID NO: 1863 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| FSCN1 | ADXCRPD.10135.C1_x_at | GGGCACATGTCCCAAGCCTGTCAGTGGCCCTCCCTGGTGCACTGTCCCCGAAACCCCTGCTTG GGAAGGGAAGCTGTCGGGTGGGCTAGGACTGACCCTTGTGGTGTTTTTTTGGGTGGTGGCTGG AAACAGCCCCTCTCCCACGTGGCAGAGGCTCAGCCTGGCTCCCTTCCCTGGAGCGGCAGGGCG TGACGGCCACAGGGTCTGCCCGCTGCACGTTCTGCCAAGGTGGTG | SEQ ID NO: 1864 |
| FSCN1 | ADXCRSS.Hs#S2731818_at | TTCCAGGCATGATTGCGGGCTTACTTGCTGTCATTCTATTTTTCAGCAAAACTCTGGGTAGGA ATGTCGGAAATTATACCTTTTGAAATCCCTCCTTGAAAACATGGAGATTTGTAGGTATGCAGA GGCAATTGTAACAATATAAAGTATTGTATCTCTTCCACTAGAGTAGGAGGGCCTGACTGTCGG CCCCTGGGTCTGTCTTCCATTACTTGTCTTGACTTCCGCTGTAAAAGCATTAAGTGGGAAGGT AGCAGTTCTGCTGAACAAGCAGACATTGCCTTCTGTAAG | SEQ ID NO: 2092 |
| FSCN1 | ADXCRAD_AJ708655_s_at | CTGTAGTAGCGAGTGATCTGGCGGGGGGCGTCTCAGCACCCTCCCCAGGGGGTGCATCTCAGC CCCCTCTTTCCGTCCTTCCCGTCCAGCCCCAGCCCTGGGCTGGGCTGCCGACACCTGGGCCA GAGCCCCTGCTGTGATTGGTGCTCCCTGGGCCTC | SEQ ID NO: 2701 |
| FSCN1 | ADXCRAD_BC004908_at | AAACCGTGGACCCCGCCTCGCTCTGGGAGTACTAGGGCCGGCCCG | SEQ ID NO: 2875 |
| FSCN1 | ADXCRAD_BC004908_s_at | GTAAGTGTCATTTGTATAACTCTAAACGCCCATGATAGTAGCTTCAAACTGGAAATAGCGAAA TAAAATAACTCAGTCTGCA | SEQ ID NO: 2876 |
| G0S2 | ADXCRPD.11190.C1_at | GATACAGTTTGTGCCATCAGGGAACACACACACTGTTTGGCAATATAAACTGTATACACCTGC AGAAGAGGGATGAAAGCACCTTTTCCGTATGTATATGATTGCCTTTACCATGTCGTAATGAGG TTTGTGATTTAATTTTCTATTTCTCCCAACATCGAGAACTCCTCCATGGCGAGGATTATTTCT CACATCCTCTAGCCCTAGCACACTGACTGGAAAATAACTGATGCTCAGGGAGTGTTTGTGAAT | SEQ ID NO: 1438 |
| GMFG | ADXCRPD.1437.C1_at | TGATCTCTGGGCTGGGGACTGAATTCCTGATGTCTGAGTCCTCAAGGTGACTGGGGACTTGGA ACCCCTAGGACCTGAACAACCAAGACTTTAAATAAATTTTAAAATGGCGCCAGGCCCCCCCAC GTAAAAGAAAANAACTTGTTCGGCCGCCCTCGGCCCCTCAAAAAACTTTTCTAAACCCTTTCG TTTGGGCCCCCGGGGCCCACTTAGGTAAGGGAAAAATGGGGCCTAAACCTGTTTCCCTAGGAA AATCCCTTGGCCATGAACTAA | SEQ ID NO: 1417 |
| GNA15 | ADXCRPD.9260.C1_s_at | CGGACGGGACCCAGTGATACTTGTATATTACACAGTCCTGATTTCAGACAAT | SEQ ID NO: 1400 |
| GNA15 | ADXCRPD.9260.C1_x_at | TGAGGAGCGGCTCAGTGTCACCTCCCACAGCCACCGGCCCTGACCCTTAATCCAGACACCGAT GGAAGTCGACTTTTCATATCTTTCTCCTGAAATGAACTCTGTTTTAAATTGGAATA | SEQ ID NO: 1401 |
| GNA15 | ADXCRPD.8623.C1_s_at | GCACTCTAGTGGACAGGAGAAGGAACGCCTTCCAGGAACCTGTGGACTAGGGGTGCAGGGACT TCCCTTTGCAAGGGGTAACAGACCGCTGGAAAACACTGTCACTTTCAGAGCTCGGTGGCTCAC AGCGTGTCCTGCCCCGGTTTGCGGACAGAGAGAAATCGCGGCCCACAAGCATCCCCCCATCCCT TGCAGGCTGGGGGCTGGGCATGCTGCATCTTAACCTTTTGTATTTATTCCCTCACCTTCTG | SEQ ID NO: 1404 |
| GNA15 | ADXCRSS.Hs#S1223446_at | AGGGACCCTACATCTGGCATCTGGATGTCACCCTGAGCACAGAAGCCTTTCCCCTCACTGGGC CAGGGACACAGATGTTCACCAAGCGTCACTCGCAGGAGTAAACACTGATGCCACAGTTGCTCC CTGCAGGGACCCTCCAGTGACGGCTGCAGAGGGCAGAGTTGCCGGTATCCTCCTGGGGCAGAA GAGCAGGCGCAGCGCCCTGCCCCGCGTGGTGAGCAGCTCAACCTCACACTCTCAGGCCACGCA CAGGCGGGAGAA | SEQ ID NO: 2061 |
| GZMB | ADXCRPD.5219.C1_at | CTATACAAATGTCCCATGGCTACCCCTACCACTATTAAGTAAATCCCAGCCTCGCCCTCCGG TACTAATACACCACCTAAAACCACTCTTGGTGGCACTGCGCTTCAGANNNNNNNNNNNNNNNN NNNNNNNNNNNNNNNNNNNNNNNNNNNNNNNNNNNNNNAATTTTCCACAGTCCTCTGACGCCCG ACCCCTGGCTCCTGGTGCAACCCGTCCACCTGGTGAACGTTCATTCTTTCGC | SEQ ID NO: 1681 |
| GZMB | ADXCRPD.5219.C1_x_at | TTCCTTTCCCTATACAAATGTCCCATGGCTACCCCTACCACTATTAAGTAAATCCCAGCCTC GCCCTCCGGTACTAATACACCACCTAAAACCACTCTTGGTGGCACTGCGCTTCAGANNNNNNNN NNNNNNNNNNNNNNNNNNNNNNNNNNNNNNNNNNNNNNNNNNNAATTTTCCACAGTCCTCTC TGACGCCCGACCCCTGGCTCCTGGTGCAACCCGTCCACCTGGTGAACGTTCATTCTTTCGC | SEQ ID NO: 1682 |
| HCLS1 | ADXCRPD.1749.C1_at | ATAAAAACCTCCTTGTTCGCTGCAGCCCCGGGGGTGTAAGGGGAAATTGGCGGCCCTGGGC CATCAGGAAAACAAGGCGCCGTGACACTCCAACAGAAGACTCGGCACCGTCCCATCCACACGGC TGCAAACTTGCGCCAAAATGCATCTAAACCACGAGAACGCCCGGGGGGATCCACCCCGCGTG GGCACGCCGCGGGGAGAGAGGGCGAACGCCGAAACCCAGGTGTGGCGAGCAAAGCTACCCCAT AAAACCT | SEQ ID NO: 1483 |
| HCLS1 | ADXCRPD.6475.C1_s_at | GTCCTCTCTATCCTGGATGAGCTCATGAACATTTCTCTTGTGTTCCTGACTCCTTCCCAATGA ACACCTCTGCCACCCCAAGCTCTGCTCTCCTCCTCTGTGAGCTCTGGGCTTCCCAGTTTGT TTACCCGGGAAAGTACGTCTAGATTGTGTGGTTTGCCTCATTGTGCTATTTGCCCACTTTCCT TCCCTGAAGAAATATCTGTGAACCTTCTTTCTG | SEQ ID NO: 1760 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| HNRNPA1 | 200016_x_at | AACTCGAGGACTGTATTTGTGACTAATTGTATAACAGGTTATTTTAGTTTCTGTTCTGTGGAA AGTGTAAAGCATTCCAACAAAGGGTTTTAATGTAGATTTTTTTTTTGCACCCCATGCTGTTG ATTGCTAAATGTAACAGTCTGATCGTGACGCTGAATAAATGTCTTTTTTTTAATGTGCTGTGT AAAGTTAGTCTACTCTTAAGCCATCTTGGTAAATTTCCCCAACAGTGTGAAGTTAGAATTCCT TCAGGGTGATGCCAGGTTCTATTTGGAATTTATATACAACCTGCTTGGGTGGAGAAGCCATTG TCTTCGGAAACCTTGGTGTAGTTGAACTGATAGTTACTGTTGTGACCTGAAGTTCACCATTAA AAGGGATTACCCAAGCAAAATCATGGAATGGTTATAAAAGTGATTGTTGGCACATCCTATGCA ATATATCTAAATTGAATAATGGTACCAGATAAAATTATAGATGGGAATGAAGCTTGTGTATCC ATTATCATGT | SEQ ID NO: 830 |
| HNRNPA1 | ADXCRAD_CN296684_s_at | GAACTGATAGTTACTGTTGTGACCTGAAGTTCACCATTAAAAGGGATTACCCAAGCAAAATCA TGGAATGGTTATAAAAGTGATTGTTGGCACATCCTATGCAATATATCTAAATTGAATAATGGT ACCAGATAAAATTATAGATGGGAATGAAGCTTGTGTATCCATTATCATGT | SEQ ID NO: 2549 |
| HNRNPR | ADXCRIH.1214.C1_s_at | CAAGCTAGTGCTTTGTCTTAGTAGTTTTAAGAAATTAAAGCAAACAAATTTAAGTTTTCTTGT ATTGAAAATAACCTATGATTGTATGTTTTGCATTCCTAGAAGTAGGTTAACTGTGTTTTTAAA TTGTTATAACTTCACACCTTTTTGAAATCTGCCCTACAAAATTTGTTTGGCTTAAACGTCAAA AGCCGTGACAATTTGTTCTTTGATGTGATTGTATTTCCAATTTCTTGTTCATGTAAG | SEQ ID NO: 1302 |
| HNRNPR | ADXCRPD.2849.C2_at | ATCAGGTCCCTTTGTGGACTCTTGCACCTTGCTCCCTGTTTCTCTCTCTGCCTGTAGGTCTT CATAACTCCACATAAAAATGCACTTTTGTTCTGAACATGTGATAAGTCACTTTCCTTGAACTG CTGTAGTACAGACAGAGCTCCTTCTTCATTAAATTCCCTGAGAGCATCAATTGCTCTTTCATC AAGATCGACATAAGCTACCAATCAGGGCAGAGCGGGGCCGGCAGCCGGGCCCGTGAGAATC AGCGCGAGGCGCTTTGAAAACGACTAGAAATGGCGCGCGCG | SEQ ID NO: 1894 |
| HNRNPR | ADXCRPDRC.2849.C2_at | GCATTTCTGTGGCAAACAACAGACTTTTTGTTGGATCCATTCCGAAGAATAAGACTAAAAGAA AACATTTTGGAAGAATTCAGTAAAGTCACAGAGGGTTTGGTGGACGTTATTCTCTATCATCAA CCCGATGACAAAAAGAAGAATCGGGGGTTCTGCTTCCTTGAATATGAGGATCACCAGTCAGCA AGCACAAGCCAGACGCCGGCTGATGAGTGGAAAAGTAAAAGTGTGGGGAAATGTAGTTACAGT TGAATGGGCTGACCCTGTGGAAGAACCA | SEQ ID NO: 2044 |
| HNRNPR | ADXCRAD_CX788441_at | CTTTGGGACCACCAAGAGGCTCTAGGGGTGGCAGAGGGGTCCTGCTCAACAGCAGAGAGGCC GTGGTTCCCGTGGATCTCGGGGCAATCGTGGGGCAATGTAGGAGGCAAGAGAAAGGCAGATG GGTACAACCAGCCTGATTCCAAGCGTCGTCAGACCAACAACCAACAGAA | SEQ ID NO: 2472 |
| HNRNPR | ADXCRAD_CX788441_x_at | CTTTGGGACCACCAAGAGGCTCTAGGGGTGGCAGAGGGGTCCTGCTCAACAGCAGAGAGGCC GTGGTTCCCGTGGATCTCGGGGCAATCGTGGGGCAATGTAGGAGGCAAGAGAAAGGCAGATG GGTACAACCAGCCTGATTCCAAGCGTCGTCAGACCAACAACCAACAGAACTGGGGTTCCCAAC CCATCGCTCAGCAGCCGCTTCAGCAAGGTGGTGACTATTCTGGTAAC | SEQ ID NO: 2473 |
| IFI16 | ADXCRIH.3101.C1_s_at | ATGTTTCATGCCACAGTGGCAACTGAGAATGAAGTCTTCCGAGTGAAGGTTTTTAATATTGAC CTAAAGGAGAAGTTCACCCCAAAGAAGATCATTGCCATAGCAAATTATGTTTGCCGCAATGGG TTCCTGGAGGTATATCCTTTCACACTTGTGGCTGATGTGAATGCTGACCGAAACATGGAGATC CCAAAAGGATTGATTAGAAGTGCCAGCGTAACTCCTAAAATCAATCAGCTTTGCTCACAAACT AAAGGAAG | SEQ ID NO: 1195 |
| IFI16 | ADXCRAD_BM806453_s_at | TTCTTCTAAAATCTGGATGTCATTGACGATAATGTTTATGGAGATAAGGTCTAAGTGCCTAAA AAAATGTACATATACCTGGTTGAAATACAACACTATACATACACCACCATATATACTAGCT GTTAATCCTATGGAATGGG | SEQ ID NO: 1433 |
| IFI16 | ADXCRPD.1023.C1_at | GTTCTCCAAAAACGCCCAGTGATAGTGAAGGTACTGAGTACAACAAAGCCATTTGAATATGAG ACCCCAGAAATGGAGAAAAAATAATGTTTCATGCTACAGTGGCTACACAGACACAGTTCTTC CATGTGAAGGTTTTAAACACCAGCTTGAAGGAGAAATTCAATGGAAAGAAAATCATCATCATA TCAGATTATTTGGAATATGATAGTCTCCTAGAGGTCAATGAAGAATCTACTGCATCTGAAGCT GGTCCTAACCAAAAATTTGAGGATGGTCCGGCACAGCG | SEQ ID NO: 2268 |
| IFI16 | ADXCRAD_CD252021_x_at | GAGCAGAGGCAACTCCTGGAGCTCAGAAAAGAAAAAAATCAACCAAAGAAAAGGCTGGACCCA AAAGGGAGTAAGGTGTCCGAAGAACAGACTCAGCCTCCCTCTCCTGCAGGAGCCGGCATGTCC ACAGCCATGGGCCGTTCCCCCATCTCCCAAGACCTCATTGTCAGCTCCACCCCAAACTTTCTC AACTGAGAAACCCGAAAACAGTGGCCCAATGTCCAGGTAAACTCCCAGAAA | SEQ ID NO: 2479 |
| IKZF1 | ADXCRAG_BC018349_s_at | GGGTTCTTAGTCTCAGCACTATGACATTTTGGGCTGACTACTTATTTGTTAGGCAGGAGCTCT CCTGTGCATTGTAGGATAATTAGCAGTATCCCTGGTGGCTACCAATAGACGCCAGTAGCACC CCGAATTGACAACCCAAACTCTCCAGACATCACCAACTGTCCCCTGCGAGGAGAAATCACTCC TGGGGGAGAACCACTGACCCAAATGAATT | SEQ ID NO: 945 |
| IKZF1 | ADXCRAD_BG685498_at | GTTAGTATAGAATTCTCGAAACTTGGGAATTCACAAATCAGGACTGGGGACTGCGAGACCACA AATTTCTGATCGCATTTCTGATGGATGTGTCACACCTTTTCTGTCAAAACTAACATGTCTTGG AGGTTAATCGACGTCCCTTGGGTGGACACACACA | SEQ ID NO: 2443 |
| IKZF1 | ADXCRAD_BG685498_x_at | GTTAGTATAGAATTCTCGAAACTTGGGAATTCACAAATCAGGACTGGGGACTGCGAGACCACA AATTTCTGATCGCATTTCTGATGGATGTGTCACACCTTTTCTGTCAAAACTAACATGTCTTGG AGGTTAATCGACGTCCCTTGGGTGGACACACACA | SEQ ID NO: 2444 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| IKZF1 | ADXCRAD_BM456472_s_at | GTGTGGTGATTGTTCAGGTCGAATCTGTTGTATCCAGTACAGCTTTAGGTCTTCAGCTGCCCT TCTGGCGAGTACATGCACAGGATTGTAAATGAGAAATGCAGTCATATTTCCAGTCTGCCTCTA TGATGATGTTAAATTATTGCTGTTTAGCTGTGAACAAGGGATGTACCACTGGAGGAATAGAGT ATCCTTTTGTACACATTTT | SEQ ID NO: 2749 |
| IL27RA | ADXCRAD_BG756941_at | GCAAGACCCTCAGTACAAAATAAACGTCAGAAACAAAAACAATTAGCTTGGGGCATTATGGCA CACACCTGTTATCCGAGCCACTTGGAAGCTGAGGGGGAGATCGGTTGAGCCAGGAGTTCGAAG TGAGGACTCTGATTGCACATGGATCCAGGTGCGTACCAATGGACTTTTTCAAATA | SEQ ID NO: 2631 |
| IL27RA | ADXCRAD_NM_004843_at | ACACTGCATTTGGGCACCATCTCAGCTCCCTTGCATCCAGGTGCAGCATGGACTGAGTTCTTG ACAACAGAATGTGGTCAGAAGTGACATATGCCAACACGGGGTCTGGGTGGGGCTCCCCCACA TCCTTTCCTTGCCTATGAGCTGGAACATAACACATGCCTATGATCCAGCTTTGGTCATACCCA AGGGGAAGGTGGAGCAAGAAATGAAAAGGAACCTGAATCCCTGAATGACTGCATGGATAGAAC CACT | SEQ ID NO: 2770 |
| IL4R | ADXCRAG_NM_000418_s_at | GGGACAATTTGCTGCCAAACACCCATGCCCAGCTGTATGGCTGGGGGCTCCTCGTATGCATGG AACCCCCAGAATAAATATGCTCAGCCACCCTGTGGGCCGGGCAATCCAGACAGCAGGCATAAG GCACCAGTTACCCTGCATGTTGGCCCAGACCTCAGGTGCTAGGGAAGGCGGGAACCTTGGGTT GAGTAATGCTCGTCTGTGTTTTAGTTTCATCACCTGT | SEQ ID NO: 1003 |
| IL4R | ADXCRPD.13542.C1_at | TCAGCTGACAACAACTTGCATAAGGGCTTACCATGTTAAGGAGCTGTCTTAGATAGCAAATAA ATATTCCAAGCTTATCTCATGTCCAAAACTAACTCCTGATTCCCGCCCCTCCCCAAAGTACCT TCTCTTCTGGCATCCTTCTACATTTCAGAAATGACAACCGCGTCCTTCCCAGTAGTTTAGGTC AGAAATCTTGGAGTCATCCTGGCCACTTCTCTTTCTCTGTCTTTCACCTCAATTCCAATCTGT CCTCAAATCTACCTCCCAGAGAG | SEQ ID NO: 1662 |
| IL4R | ADXCRSS.Hs#S523708_at | CCAGTGGACACAGAATGGAAGGACTGTTCCCAGTTCGGTTTTCAATCAGCAGCAGGCATGCCT TCCAGCAAGCACACCTCATCTCAATACGCCTTCCTGGGCACTTAAGTTCAGGGGTGGAAACAG CTGGGCTGAAGGGGGCTTGGTGGTCTACTGCGACCAGCTCCGTTTCAAAGGTGGGAGGACTGA GGCCCAGGCAGGGGCAGGAATCCCATCAGATTTGGGAAAATACAGGGCGGCTTCCTC | SEQ ID NO: 2128 |
| IL4R | ADXCRSS.Hs#S3742921_at | GATCTGAGCTTGTATTTGGTGCCCAGGACATGTGCTGGGTTCCGAAATCCCAAAGACACAGA CCCTACCCTCAGGGATTTCTCATTCTAGCAACATAGACTGATCAATTACTGATTATAACGTTA GAAGGCATGTCTGAAGTAGACAGCCATCAGGACATGGTGATTTCAGGCTGGGCTTTGAAGAAT GACTAGGAGTTTTTCAAGTGTCGAAACTGAACCCTGACCAACCTTTGCTTTTGCAGAC | SEQ ID NO: 2185 |
| IL4R | ADXCRAD_AA767714_at | GCCAATGGCAGATGAGAATCAATTCAAAACTTTCCCAAGCACCTGGTTCTGTGCTGGGTTCTG GAGATACAGCCATGGAGACCCTGCCTATGGAGCTCACAGCCCAGGGCAGGAGCACGTGGCTC AACTGATATCCACAGTGCAGGATGAGCAATGCTGAGAGGGCTGTGCGGTGGCAGGGTCAGGGT ACTGCCAGCTGCCACTGCACCTACCACGTTGAAGAATCTTCTTTCATTGAGTTTTCACGACAG CCCTTACTCCT | SEQ ID NO: 2896 |
| IL6R | ADXCRAG_NM_181359_at | ACCACCATCACCAGACAGGTGCGAAAGGATGAAAGTGACCATGTTTTGTTTACGGTTTTCCAG GTTTAAGCTGTTACTGTCTTCAGTAAGCCGTGATTTTCATTGCTGGGCTTGTCTGTAGATTTT AGACCCTATTGCTGCTTGAGGCAACTCATCTTAGGTTGGCAA | SEQ ID NO: 1055 |
| IL6R | ADXCRAD_BP313907_s_at | AAGCACCATAACTTTGTTTAGCCCAAAACCAAGTCAAGTGAAAAAGGAGGAAGAGAAAAAATA TTTTCCTGCCAGGCATGGTGGCCCACGCACTTCGGGAGGTCGAGGCAGGAGGATCACTTGAGT CCAGAAGTTTGAGATCAGCCTGGGCAATGTGATAAAACCCCATCTCTACAAAAAGCATAAAA TTAGCCAAGTGTGGTAGAGTGTGCCTGAAGTCCCA | SEQ ID NO: 2450 |
| INSIG1 | ADXCRIH.1510.C1_s_at | GAATGACCCCCTTATATATTTTCTGAAAATGAAAACAGTTACATGAAAAAAATTTCCAATGAA GATGTCAGCATTTTATGAAAAACCAGAAGTTATTAGATGAAAGCAGCGAGTGAATCTTTAAAC AGACTTGATCACGCACACACAATAAGTCTTTCTCTCC | SEQ ID NO: 1196 |
| INSIG1 | ADXCRAD_BU191559_at | AATCTATTTAGATCGGGCTGACTGTACAAATGACTCCTGGAAAAAACTCTTCACCTAGTCTAG AATAGGGAGGTGGAGAATGATGACTTACCCTGAAGTCTTCCCTTGACTGCCCGCACTGGCGCC TGTCTGTGCCCTGGAGCATTCTGCCCAGGCTACGTGGGTTCAGGCAGGTGGCAGCTTCCCAAG TATTCGATTTCATTCATGTGATTA | SEQ ID NO: 2371 |
| INSIG1 | ADXCRAD_BU570382_at | GATTTTTTGCCAATAGTTTATAGAAAATATATGAACCAAAGTGATTTGAGTTTGTAAAAATG TAAAATAGTATGAACAAAATTTGCACTCTACCAGATTTGAACATCTAGTGAGGTTCACATTCA TACTAAGTTTTCAACATTGTGT | SEQ ID NO: 2372 |
| INSIG1 | ADXCRAD_BU570382_x_at | GATTTTTTGCCAATAGTTTATAGAAAATATATGAACCAAAGTGATTTGAGTTTGTAAAAATG TAAAATAGTATGAACAAAATTTGCACTCTACCAGATTTGAACATCTAGTGAGGTTCACATTCA TACTAAGTTTTCAACATTGTGTTCTTTTGCATTCATTTTTA | SEQ ID NO: 2373 |
| INSIG1 | ADXCRAD_AL541939_s_at | TTTTAAATTCTGTGAAAGTGGCTTGATTAAAAG | SEQ ID NO: 2611 |
| ITK | ADXCRAD_NM_005546_at | TGGTATTACCTTTTTCAAGCTCAGATTCATCTAATCCTCAACTGTACATGTGTACATTCTTCA CCTCCTGGTGCCCTATCCCGCAAAATGGGCTTCCTGCCTGGTTTTTCTCTTCTCACATTTTTT | SEQ ID NO: |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| | | AAATGGTCCCCTGTGTTTGTAGAGAACTCCCTTATACAGAGTTTTGGTTCTAGTTTTATTTCG TAGATTTTGCATTTTGTACCTTTTGAGACTATGTATTTATATTTGGATCAGATGCATATTTAT TAATGTACAGTCACTGCTAGTGTTCAA | 2767 |
| JUNB | ADXCRIH.455.C1_s_at | GAAACAGACTCGATTCATATTGAATATAATATATTTGTGTATTTAACAGGGAGGGGAAGAGGG GGCGATCGCGGCGGAGCTGGCCCCGCCGCCTGGTACTCAAGCCCGCGGGGACATTGGGAAGGG GACCCCCGCCCCCTGCCCTCCCCTCTCTGCACCGTACTGTGAAAAGAAACACGCACTTAGTC TCTAAAGAGTTTATTTTAAGACGTGTTTGTGTTTGTG | SEQ ID NO: 1165 |
| KBTBD11 | ADXCRPD.18308.C1_at | AGGCAGTCTCAGCAATGCCTCTGCCCTCCCTGCAGCAGTCCCAAAATGAACAGCCACACCTTG GAGGGTGTGGCTTTTCTGTTTCATGCGGTGCAAACCCTAGCGGCTCCACACCCCAGGGACTGG CCCCCAAAAGCAAAAACACTGCTCATGGCTTGGCAGGTCCTCCTAGTATGTATTTTTATGTGA TATCACTATTCAGAACTGTGGTGTATACTATTCTATAAATTTCCACTATAGGTTGGCCGGACA TCCTTTAATGCTGGGTATTAATTCCTCTTATTCT | SEQ ID NO: 1420 |
| KBTBD11 | ADXCRPDRC.18308.C1_at | GGTTCATGTGAGATGCAGAGGCAATGAGCTTGAGCCTTCCTACCTTTACTTCCGGCTGGATAC TTGCTCTGGGGAACAATCCCATCAATACCGCAGACGGCTTTGCCGGCCGCCTTCGCCAAAGCC TGGGATTCGGAAACATACGGGGAAACGGGGCGCGGAATCCGAGGAGGGCCACGACAGCGACCA GGGAGAAAACGGCAGGTGCGGGAAGAACCTGGGCCACACAACAAAAACACGGAAGTGAGAAC ACCTGGCCACACGAAGGAAGACATGAA | SEQ ID NO: 1927 |
| KBTBD11 | ADXCRAD_NM_014867_at | CTTCAGACACGCCAAGTGGATGGATTTGGATTGAACGCATATGAAACAGGAGACGGGTTCTCA TGTGAGATCAAAGCTCCTCCAAAGCCTGTTCAAGCTCTAAGCGATTCTCAAATGTTACCATTT ATTAAAGGTAAACTACACCTGTTGAAGGCCAAGTTCAGGGCAGCTGTTGTGATCTGTGTAGTT AATGTATTTATTAATGCTTGACTTTTAAAATCCTGGGCATAAATAGTGCAGAGCCTCGTATGT TTGTCAGTTCATGCCGAGATG | SEQ ID NO: 2772 |
| LARS2 | ADXCRAG_BC025989_s_at | GATGGCCAGGAATGGACTCATACCATTGGCACATTAGGCTAATCCTGGTTTTATGTGAAGTCA GCAATTAAGTGTTCCCACTAGAACTGACCTAAGCCACTGATTAATATTTAATGAGGGAAGGTA GGGGAGAATCTAGCCATTTTATAATGCCAGAAATCTATATATGTTATCTGATGCCATTTTTCT GAAGTAGCCTCACATGTGGTCCCCCTGCAGTTCAGCAGTTAACAGATGACTTTTTTAGT | SEQ ID NO: 950 |
| LARS2 | ADXCRSS.Hs#S2986318_at | GATGCCACAGCAGATGTGTCAAACCATTTTTCCTGCTCATGGCATGTAGTTTGAGAGAGCTTG ATAGTGAAGCTGCCAGCTCAGCTGTGACTGGCCACTCATTTGCAGACTAGAATGCCTTACTGG CCTGGGCTTGCTTAAGGTAATTGCTTCTAGACTCCTCACTCCTGCTGGGCCACAGTTGCTTGA ACAGTCAAATAAGGGGTTGGGGGGTAGAGGATATATCTCAAAACCTTCTTTGTGCTTGAAGAT TTGTGATTCCTTGTTCTTTGGAGAA | SEQ ID NO: 2164 |
| LARS2 | ADXCRAD_AK025190_x_at | TGTAATCACAGAACATGGGGAAGCTGAGGCAGGCAGATTGCTTGAGGCCAGGAGTTAGAGACC AGCCTGGCCAACATAGTCAAACTCTGTCTACTAAAAATACAAAAATTAGCCAGGTGTAGGG GCTCATGCCTGTAATCCTCCCAAGAAGCTGGGCTGAGGCACGAGAATTGCTTGAACCCAAGGG GCATAGGTTGCAGTGAGCCAAGATCATGCTGCTGCCCTCCAGCTTGGGCAATAAAGCA | SEQ ID NO: 2820 |
| MAP4K1 | ADXCRAD_BG397984_s_at | TTCTGGAAGCATGGAGTGCAGGTGTGGGCTCTAGGCTCGGATCAGCTGCTACAGGAGCTGAGA GACCCTACCCTCACTTTCCGTCTGCTTGGCTCCCCAGGCCTGTAGTGGTGGAGACACGCCCA GTGGATGATCCTACTGCTCCCAGCAACCTCTACATCCAGGAATGAGTCCCTAGGGGGGTGTCA GGAACTAGTCCTTGCACCCCCTCCCCCATAGACACACTAGTGGTCATGGCATGTCCTCATCTC CCAATAAACATGACTTTAGCCTCTGCAAAA | SEQ ID NO: 1070 |
| MCL1 | ADXCRAG_AF118124_s_at | AGTTTTCAATAATTAGGTCTAAGTGGAGTTTTAAGGTTACTGATGACTTACAAATAATGGGCT CTGATTGGGCAATACTCATTTGAGTTCCTTCCATTTGACCTAATTTAACTGGTGAAATTTAAA GTGAATTCATGGGCTCATCTTTAAAGCTTTTACTAAAAGATTTTCAGCTGAATGGAACTCATT AGCTGTGTGCATATAAAAAGATCACATCAGGTGGATGGAGAGACATTTGATCCCTTGTTTGCT TAATAAAT | SEQ ID NO: 861 |
| MCL1 | ADXCRIH.2623.C1_s_at | AGAAGGATGGCGCTCCCAGTGACTACTTTTTGACTTCTGTTTGTCTTACGCTTCTCTCAGGGA AAAACATGCAGTCCTCTAGTGTTTCATGTACATTCTGTGGGGGGTGAACACCTTGGTTCTGGT TAAACAGCTGTACTTTTGATAGCTGTGCCAGGAAGGGTTAGGACCAACTACAAATTAATGTTG GTTGTCAAATGTAGTGTGTTTCCCTAACTTTCTG | SEQ ID NO: 1101 |
| MCL1 | ADXCRIH.2463.C2_at | CATAAGCCGCTTATTTATATCATGTATCTCTAAGGACCTAAAAGCACTTTA | SEQ ID NO: 1267 |
| MCL1 | ADXCRIH.2463.C2_s_at | TCTTAAGATCTGGTTACGGTAACTAAAAAAGCCTGTCTGCCAAATCCAGTGGAAACAAGTGCA TAGATGTGAATTGGTTTTAGGGGCCCCACTTCCCAATTCATTAGGTATGACTGTGGAAATAC AGACAAGGATCTTAGTTGATATTTTGGGCTTGGGGCAGTGAGGGCTTAGGACACCCCAAGTGG | SEQ ID NO: 1268 |
| MCL1 | ADXCRPD.7685.C1_s_at | GCAACCACGAGACGGCCTTCCAAGGCATGCTTCGGAAACTGGACATCAAAAACGAAGACGATG TGAAATCGTTGTCTCGAGTGATGATCCATGTTTTCAGCGACGGCGTAACAAACTGGGGCAGGA TTGTGACTCTCATTTCTTTTGGTGCCTTTGTGGCTAAACACTTGAAGACCATAAACCAAGAAA GCTGCATCGAACCATTAGCAGAAAGTATCACAGACGTTCTCGTAA | SEQ ID NO: 1835 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| MCL1 | ADXCRAD_BP365482_s_at | AGGAGATGGAAGCCCCGGCCGCTGACGCCATCATGTCGCCCGAAGAGGAGCTGGACGGGTACG AGCCGGAGCCTCTCGGGAAGCGGCCGGCTGTCCTGCCGCTGCTGGAGTTGGTCGGGGAATCTG GTAATAACACCAGTACGGACGGGTCACTACCCTCG | SEQ ID NO: 2345 |
| MCL1 | ADXCRAD_BQ962674_at | ACCATGGTGCTATTATTAGGCTTGCTTGTTACACACACAGGTCTAAGCCTAGTATGTCAATAA AGCAAATACTTACTGTTTTGTTTCTATTAATGATTCCCAAACCTTGTTGCAAGTTTTTGCATT GGCATCTTTTTGGATTTCAGTCTTGGATGTTTGTTCTATCAGACTTAACCTTTTATTTCCTGTC CTTCCTTGAAAATTGCTGATTTGGTTCTGCTCCCTCTACAGATAATTTATATCAATTTCCCTA CAGCCTTTC | SEQ ID NO: 2346 |
| MCL1 | ADXCRAD_CX866513_at | TTGGCAGACAGGCTTTTTTAGTTACCGTAACCAGATCTTAAGATTAATTAAAAACTACATAAA GTGCTTTTAGGTCCTTAGAGATACATGTATATAAATAAGCGGCTTATGATCAAGAACGATAAAT ACATAGGTAAAATAGCTCTAGCAAAGATGACCTTATGGCTCTGAGATGGGCAGGCAGGGCAA TTCTTCCCCATTACATTCTTAGTCATCTTATTCATACCTATTTTAAATGGAGTCCACAGACT AAAGGTCATGTTCCGAGACTGAAGCTTTCAAATGACCCTAGTTCCAAT | SEQ ID NO: 2558 |
| MCL1 | ADXCRAD_BF981280_at | AACCATAGGCGACAGCGGACACCAACAAACGAGCAGAAACTCCACCAGCTGAAACGCAGCCAT GCAGAGCAAACACAGAGCAACCACGCATCATCATACAAAAAGCCAGAGCCACCACGGAACCCA TACACGAAACAGTAACAACAAGCAGCACAACAACACCGCCGTCCGACACACACGTCGATCAAA TACAGACACCGATAGCAAAACATAGCAACAACGAGAGCGAATCGAAAGCCTCAACGCCTCAAC CCCCTAGTCAGTCCCACGCCACATATACG | SEQ ID NO: 2667 |
| MCL1 | ADXCRAD_BF724558_at | GCCCGACCCGGAGAGCTGTTTCTTAATCTGCCTGGAGGAAAATCCCAGCCCCCAAATTTCCAC ATACTTCACATAGATAACACTGTAACAACTTTGAAACTAAGAGGGAGAGA | SEQ ID NO: 2841 |
| MCL1 | ADXCRAD_BF724558_x_at | CCCAGGCCCCGGAGTGCAATGGCATGATCTCAGCTCACTGCAACCTCCGCCTCCCGGGTTCGA GCGATTCTCCTGCCTCAGCCTCCCAAAGTGCTGGGATTACAGGCCTGAGCCACAGCGCCCGAC CCGGAGAGCTGTTTCTTAATCTGCCTGGAGGAAAATCCCAGCCCCCAAATTTCCACATACTTC ACATAGATAACACTGTAACAACTTTGAAACTAAGAGGGAGAG | SEQ ID NO: 2842 |
| MFNG | ADXCRPD.17460.C1_x_at | TGGCAATTGGCACTGAAGGCACCCAAGCCCCTGGAGCCTTTCTTGCGGTTAGGGCTAACATGG ACCAGCTTTGGCAGAGGAACTAAGCAATCCAATAAGATGTTCTTGGAAAGTTTTGAGCCACTC CCATCTTCTGGCAAAATGTGGGTTGAAGGCGGATCT | SEQ ID NO: 1873 |
| MFNG | ADXCRPDRC.7895.C1_s_at | AACCCAAGGGCGCTGCTGCAGCTTCTGAGAGCCTTCCCGCTGGCCCGCGACGTCTATGTGGGA AGGCCCAGCCTGAACCGGCCCATCCATGCCTCAGAGCCACAGCCCCACAACCGCACGAGGCTG GTACAGTTCTGGTTTGCCACTGGGGGTGCTGGCTTCTGCATCAATCGCAAACTGGCTTTGAAG ATGGCTCCGTGGGCCAGTGGCTCCCGTTTCATGGACACATCTGCTCTCAT | SEQ ID NO: 2043 |
| MFNG | ADXCRAD_NM_002405_at | ACGGGTCCCAGCCAATTGTGATGATCCTTTTTGCTCATTTCCCAGCCTTTCTTGCTGTTAGGG GCTACCATGGGACCAGCTCTGGCCAGAGGGAACTAAGCAAATCCAATAGAGATGTTCTGGGG AAGGTTTTGCAGCCCACTCCCCATCTTCCTGCTATAAATGTGGGTGTGATGGCTGGATCTGGG GCAGCCACCTTGCTACCATGAAGGAAAGGCCAAGACAATCATCCACAGCTATTCCTCCAGCA TCTGGTTCTGTACAAAAATTA | SEQ ID NO: 2775 |
| NAP1L1 | ADXCRIH.187.C2_s_at | TGAAAACTTCCTTTCTGAGAAGTTAGTGTTAAGGTCTTGGAATGTGAACACATTGTTTGTAGT GCTATCCATTCCTCCTCTGAGATTTTAACTTACTACTGGAAATCCTTAACCAATTATAATAGC TTTTTTTCTTTATTTTCAAATGATTTCCTTTGCTTTGATTAGACACTATGT | SEQ ID NO: 1301 |
| NAP1L1 | ADXCRPD.3079.C1_s_at | TCAAAGATAGAATCCCATTTTTAATGAACTGAAGTAGCAAAATCATCTTTTTCATTCTTTAGG AAATAGCTATTGCCAAAGTGAAGGTGTAGATAATACCTAGTCTTGTTACATAAAGGGGATGTG GTTTGCAGAAGAATTTTCTTTATAAAATTGAAGTTTTAAGGGACGTCAGTG | SEQ ID NO: 1494 |
| NAP1L1 | ADXCRPD.367.C1_s_at | AGTGAAGTTCTCAGATGCTGGCCAGCCTATGAGTTTTGTCTTAGAATTTCACTTTGAACCCAA TGAATATTTTACAAATGAAGTGCTGACAAAGACATACAGGATGAGGTCAGAACCAGATGATTC TGATCCCTTTTCTTTTGATGGACCAGAAATTATGGGTTGTAC | SEQ ID NO: 1910 |
| NAP1L1 | ADXCRAD_BP220549_at | AGTTACTGGTACCACAGTGAGGTGAATAAAACGGGATTTTCAGAAGTTAGCCTGAATTTAACT GTATTTTTAAATTTAACCTCCATTAACTAAGCATCTTTTCTTTGTGGTAGGGTCTACCTTCTG CTTCCCTGGAAAGGATGAATTTACATCATTCGACAAGCCTATTTTCAAGTTATTTGNTGGTTG TTTGCTTGTTTTTGTTTTTGCAGCTAAAATAAAAATTTCAAATACAATTTTAGTTCTTACAAG ATAATGTCTTAATTTTGTACCAATTCAGGTAGAAG | SEQ ID NO: 2470 |
| NAP1L1 | ADXCRAD_BP220549_x_at | AGTTACTGGTACCACAGTGAGGTGAATAAAACGGGATTTTCAGAAGTTAGCCTGAATTTAACT GTATTTTTAAATTTAACCTCCATTAACTAAGCATCTTTTCTTTGTGGTAGGGTCTACCTTCTG CTTCCCTGGAAAGGATGAATTTACATCATTCGACAAGCCTATTTTCAAGTTATTTGNTGGTTG TTTGCTTGTTTTTGTTTTTGCAGCTAAAATAAAAATTTCAAATACAATTTTAGTTCTTACAAG ATAATGTCTTAATTTTGTACCAATTCAGGTAGAAG | SEQ ID NO: 2471 |
| NAP1L1 | ADXCRAD_CX870261_s_at | CAAGGGACGTGGGACAGTTCGTACTGTGACTAAAACAGTTTCCAATGACTCTTTCTTTAACTT TTTTGCCCCTCCTGAAGTTCCTGAGAGTGGAGATCTGGATGATGATGCTGAAGCTATCCTTGC TGCAGACTTCGAAATTGGTCACTTTTTACGTGAGCGTATAATCCCAAGATCAGTGTTATATTT TACTGGAGAAGCTATTGAA | SEQ ID NO: 2555 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| NAP1L1 | ADXCRAD_BQ884238_at | GACTATGACCCAAAGAAGGATCAAAACCCAGCAGAGTGCAAGCAGCAGTGAAGCAGGATGTAT GTGGCCTTGAGGATAACCTGCACTGGTCTACCTTCTGCT | SEQ ID NO: 2641 |
| NARF | ADXCRAD_CN367752_s_at | GGAGGTCCTCGCCTGTGCTGGAGGATGCTTAAATGGCAGAGGCCAAGCCCAGACTCCAGACGG ACATGCGGATAAGGCCCTGCTGCGGCAGATGGAAGGCATTTACGCTGACATCCCTGTGCGGCG TCCGGAGTCCAGTGCACACGTGCAGGAGCTGTACCAGGAGTGGCTGGAGGGGATCAACTCCCC CAAGGCCCGAGAGGTGCTGCATACCACGTACCAGAGCCAGGAGCGTGGCACACACAGCCTGGA CATCAAGTGGTGAAGTCAGGCCAGGGCCTT | SEQ ID NO: 940 |
| NARF | ADXCRSS.Hs#S2978401_at | GAAACAGTACTTGGATCCACATCTTAGTCAAATTATTAAAATACAGCAGACAAGGACAGGATC ATAGTCCTCATCTTTCTCTCTTCCCCCACATTAATACATTATTATTTCAATGAAATGAGCCAA ATTTTAAACCTAAACTACTTATGTACTCTTGCAAATTTTCTGATAATTTTTAATATAAATTCA AAACATAAATTCATTTTGAAGTTGGAATTTGAATAAACTCATTGTGGTTCAAATAAGAGACCA ACGAC | SEQ ID NO: 2147 |
| NFIL3 | ADXCRAD_BG925633_s_at | GAGACTTATAGCCACACAACCAATCTCTGCTTCAGACTCTGGGTAAATTACTACTGAGTAAGA GCTGGGCATTTAGAAAGATGTCATTTGCAATAGAGCAGTCCATTTTGTATTATGCTGAATTTT CACTGGACCTGTGATGTCATTTCACTGTGATGTGCACATGTTGTCTGTTTGGTGTCTTTTTGT GCACAGATTATGATGAAGATTAGAATGTGTTATCACTCTGCCTGTGTATAGTCAGATA | SEQ ID NO: 1805 |
| NFIL3 | ADXCRSS.Hs#s5972058_at | GGGCCGAAGTGATGATGTATCTAATATTATATCCTAGAACATTCACAGAGTAGCTGCAGAATG TCTTGAGCTGGAACATCCCCAAGAGGCCATATATATATCCCAGGGATTTTACAGTGGACCTCA CTAGGCCGGAGTAACTGTAAAGTCAGATGGATAATGAGAATTCAGGACGTTAGCCACACGTGG ACTGTGGCAAAAAGAAAGTGACCCACTGAAGAAGACTGTTTTTCAGCTCTCTCATCAATTGCT GTTTCCAGGAGCCCACAGCTCCAATTACTCAAAAGA | SEQ ID NO: 2062 |
| NFIL3 | ADXCRAD_AK095268_x_at | GGAGATCAAAACCATCTTGGCCAACATGGTGAAATCCCATCTCTACTAGAAAATACAAAAATT AGCTGGGTGTGGTGGCATGTGCCTGTAGTCCCAGCTACTCGGGAGGCTGAGCCAGGAGAATTA CTTGAACCGGGGAGGTGGAGGTTGCAGTGAGCCAAGATCACTCCACTGCACTCTAGCCTGGTG ACAGAGCGAGACTTTGTCCCAAA | SEQ ID NO: 2795 |
| PDE4DIP | ADXCRAG_BX647660_s_at | GCCAGACCAACTCTGTTGAAATTCTTGCATAGAGCAAACCTGTGCTCATTTTTAAGTGGCATG GGAGAGGCCCCAAGCCTAGTAAAGCCTAGTCTGTGTCTTCACAGTGCTGGTAGAATGTGTTCG TGTGTATAAATATATGATATAGATTTATATATGTTGCTAACGCCATATATTGAAGGCCAACAT AACTGGTGGACAGGGT | SEQ ID NO: 983 |
| PDE4DIP | ADXCRPD.5634.C1_at | CACGGGTTCTTATATGAAGATACACTTATAATCTGGTATGTTACCTGGTCAAGAGGAAATTCA ATATACAAGACAGGCATGAACCTTGGAGCACTTCTTCCTGACAGTATAAGTGGAACTTAAAGG ACGTCAAGTGCCAATAGGAACTTACATACAAGCAGCCAGAGTACAGTCCCATATGGGAGATAA CACGAAATCACTAATCCTTCTTTTCTTTGCTTTTGCTATCATAGTCTCGAA | SEQ ID NO: 1739 |
| PDE4DIP | ADXCRAD_CK002790_at | TCTTCATTTTAGAATGTTATCTTGGTATGTTTAAAAGGAAAAACTTAAGATGTGTTGCAATTG CAGTATGAGTTTCAGGTATGTACATGTTATGTGTGTGTGAGAGACACACACAAACACATTT CAAACATGTTTTATGTTTAAGCTCAATATTCAAACACAGAAATATAACATCTATTCTTAATAT GTTTTATGTAAGTACAGCAGCAGCATTATTAAATACTGTATTTCTATGGTGATTGAAAATTAG TANGCAGAGAATTTTGTATGGGTCTTAATATTTTTGTATA | SEQ ID NO: 2498 |
| PDE4DIP | ADXCRAD_CK002790_x_at | TCTTCATTTTAGAATGTTATCTTGGTATGTTTAAAAGGAAAAACTTAAGATGTGTTGCAATTG CAGTATGAGTTTCAGGTATGTACATGTTATGTGTGTGTGAGAGACACACACAAACACATTT CAAACATGTTTTATGTTTAAGCTCAATATTCAAACACAGAAATATAACATCTATTCTTAATAT GTTTTATGTAAGTACAGCAGCAGCATTATTAAATACTGTATTTCTATGGTGATTGAAAATTAG TANGCAGAGAATTTTGTATGGGTCTTAATATTTTTGTATA | SEQ ID NO: 2499 |
| PDE4DIP | ADXCRAD_BG192476_s_at | AATGCTGGGAAGTCCTAACCACATCAAGAATGCCTCAGATCAGTGACC | SEQ ID NO: 2630 |
| PDE4DIP | ADXCRAD_H24473_at | AACTCATACTGCAATTGCAACACATCTTAGTT | SEQ ID NO: 2888 |
| PDE4DIP | ADXCRAD_H24473_s_at | GCCTACTAATTTTCAATCACCATAGAAAATACAGTATTTAATAATGCTGCTGCTGTACTTACA TAAAACATATATTAAGGAATAGATGTTATATTTCTGTGTTTGAATATTGAGCTTAAACATAAAC ATGTTTGAAATGTGTTTGTGTGTGTCTCTCACACACACACATAACATGTACATACCTGAAACT CATACTGCAAT | SEQ ID NO: 2889 |
| PHF11 | ADXCRIH.2487.C1_s_at | TTCCTAAGCCAAGAGTCATGTCAAATTGCAATCAGGCTCAAAACCAGAGACCAGGCTGTGAAA TCCACACATCTTTAGAACTAGTCGTCTCCTCTTGGCCTCAGCAGCTCTTCCCTGTTCTTACTG GTTGACATTTTGATCACTCTTTGCACACTCTTGTGTTTTTTGCTCACTGTCACACTCCCAGCA CCTAGTATGCTCAGTAAATGTTTGTGGAATAAGTGCATAAAATGTTCTTAACCTTTGATTCTA CTTACAGCCCATGATAGCCTCTTAGATA | SEQ ID NO: 1161 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| PHF11 | ADXCRAD_BE621153_at | AAAACAATCGGAACACAAGTCAGTAATTAGTAGACACAGCAGATCGTACCAACGGCCGGCTAA AGGGCCCGACACTAAAATACCATCGACCACACCACGAGCCAAACACACACAACGGGCA | SEQ ID NO: 2595 |
| PLAGL1 | ADXCRPD.569.C1_s_at | TTTTCTTTGCTCTGTCTAGCTTAAACTACTACTCAAGCTGCTTAAGTTCTTAAGTATTGTTTG TAATCACCAATAAATAAGTGCATTTGTAATTCATCAGTCATTATTAGCTTTTATTAAAAGAAG ATTACGTTTTACAATGTAACTATAATCTCTTGAATTTGGTATCTTATTAATGAGTTTTAAAGA TGTAAAACCTAACCTTTTTTAAAGCTCCATTGTCTTATGTTT | SEQ ID NO: 1565 |
| PLAGL1 | ADXCRAD_CA942280_s_at | ATGATATACTATGACTAGGCTGTGTATTTCTTTTCAGGGATTTTTCTACCTTCAGGGTTGGAT GTAGTTTAGTTACTATTACCATAGCCAACCTGTAGTTTTACATATACATTTTCTTGTGGAGCA ATAGAGTTCTCCATTTTACAGAAGCATTTTAAATGTAGTTTGAATATTTTCCACAAGATGCTG CAATGTGAGTTATCACTTCATTTATCTTA | SEQ ID NO: 2495 |
| PMAIP1 | ADXCRAG_BC013120_at | GGAACAGTTAGTTCTCATCTAGAATGAAAGTTCCATATATGCATTGGTGAATATATATGTATA CACATACTTACATACTTATATGGGTATCTGTATAGATAATTTGTATTAGAGTATTATATAGCT TCTTAGTAGGGTCTCAAGTAAGTTTCATTTTTTTATCTGGGCTATATACAGTCCTCAAATAA ATAATGTCTTGATTTTATTTCAGCAGGAATAA | SEQ ID NO: 936 |
| PMAIP1 | ADXCRPD.936.C1_at | GATTCAGAAGTTTCTGCCGGAAGTTCAGTTTGTCTCCAAATCTCCTGAGTTGAGTAGCACACT CGACTTCCAGCTCTGCTGGAGCCCGCGCGGGGCTCGGTTGAGCGTTCTTGCGCGCCTTCTTCC CAGGCATCTCCGCCGGTGCCGCCGCCCACTCAGCTACAGAGCCCGGGAACCTCAGCCTCCAAC TGGAGCACCTCGGACAGCTGCAGGACGCGAGCTGAACACGAACAGTCCTGCAGGCAGGGATGG GGAATCGGGTGTCCGGACGCGCGAT | SEQ ID NO: 1633 |
| PMAIP1 | ADXCRPDRC.936.C1_s_at | CTTGGGGCCAGTAAATCAGTAGACTGAACATTCAATATAATAAAAGAACATGGGGATTTTGTA TAACCAGGGATAATAAAAAGAAAACAGAAGTTGATTTTTAATTGATGTTTTTGAAACTTAGTA GAACAAATATTCAGAAGTAACTTGATAAGAAATGATGTTTCTAAAGAAGTTTCTAAAGATTC GGAAAATGCTCCTTGTCACATTAGTGTGCATCCTACAAAAAGTGATCTCTTA | SEQ ID NO: 1977 |
| PNMA2 | ADXCRAG_XM_376764_s_at | TATTTTTTCTGATTGTGGTTCAGTTTAACTGAAGAATATCCTGAGATTGTAAGAAAAGCATTT TTTAAAAGGTATCACTTGTGATCATTTATCTTTCTAAATTCTATTTTTAATACTGTTCCACCA AAGTGATGCAGTGGTTACCATGACACCCTAATTTCATGTGTTTTTGTATTTATGAAAATAGTT TCATTGTCATTTATTGGCGGTAT | SEQ ID NO: 1092 |
| PNMA2 | ADXCRAD_BU073065_s_at | CCTGGGGGCAGGACCCACAGCCAGTGGGCTAAGACCTTTAAAAAATTTTTTCTTTAATGTAT GGGACTGAAATCAAACCATGAAAGCCAATTATTGACCTTCCTTCCTTCCTTCCTTCCCTCCCT TCCTCCTTCTCTCCTTCTCTCCTCCTCTCCTCTCCTCTCTTCCTTCCTTCCTTCC TTTTTTTCTTTTTCTCTTTCTTCTTTATTTCTTGGGTCTCACTCTCATCACCC | SEQ ID NO: 2647 |
| PPRC1 | ADXCRPD.9220.C1_at | CAGGTATTGAAACAAGTTAACTTGCATTCCTATGTAAGATAGGAGGGGCTGAGGGGATCCCCA GTGTTTGGAACATAAGTCACTATGCAGACTAATAAACATCAACTAGAG | SEQ ID NO: 1398 |
| PPRC1 | ADXCRPD.9220.C1_x_at | TCCCTGCTATCCTTTTTCTCCTTTGGAGGTGCNCCAACCTCCTCCACCCCCTTCCCCTACTCT AGGGGAGAGAGCTGCTAGTGAGATGACTGTTTTATAAAGAAATGGAAAAAGTGAAATAAAAA ATATGTTGAATCAGATTTTTTAAAAGGGGTATTTGTTTTTTATAACAGGTATTGAAACAAGT TAACTTGCATTCCTATGTAAGATAGGAGGGGCTGAGGGGATCCCCAGTGTTTGGAACATAAGT CACTATGCAGACTAATAAACATCAACTAGAG | SEQ ID NO: 1399 |
| PPRC1 | ADXCRPD.16668.C1_at | AGGGCTTCACTGCAGAGCTGTCTTCTTGGCTGGGGCTGGTGGGATGACAAGACAAGGGATGTC TGCCAGCCCTGTGGGAGTCTCTGGAAGGCTAGGCCACTTCCCAGTTGGGGGCTGTGGACTTCT CTCTTCTGTTTCTGCTTGGCGTTGCTGCCTTCGTCGCCGGTACTCAGATAAGCTGAGAGGCCG AGGTCTGGCTTCATGGGTTGTAGCACTGGTACCACTTTCAATTTTCA | SEQ ID NO: 1832 |
| PPRC1 | ADXCRPDRC.16668.C1_at | GAAGAGAGAAGTCCACAGCCCCCAACTGGGAAGTGGCCTAGCCTTCCAGAGACTCCCACAGGG CTGGCAGACATCCCTTGTCTTGTCATCCCACCAGCCCCAGCCAAGAAGACAGCTCTGCAGTGA AGCCCTGAAACACCCCTTGAGATTTGCCTTGTGCCTATAGGTCCCAGCCCTGCTTCTCCTAGT CCTGAGCCACCTGTAAGCAAACCTGTGCCTCATCTCCCACTGAGCAGGTGCCATCCCAGAAGA TGCCACTGTTGGCGAGACCTT | SEQ ID NO: 2033 |
| PRF1 | ADXCRAD_BQ654088_at | TTCTTTGGCCTTAATGGGAGCCCATCAACTTCAACTGCTCGTGGCTTCTTTGCCCACATGCTT TTCCCCTGAAAAAAATGGAGGGCCGGCCCTGACCTGGCCTCACAATGAAACTAAA | SEQ ID NO: 2314 |
| PRF1 | ADXCRAD_BQ654088_x_at | TGCAGTCACAGCTACACAGATCACAGCTTCAGCCAGGAGCTGGGCAGAAAGCCAAGAGGCTGT TCCCACCAGGCTGCTCAGGGCTGGTCTTTTAGGACCCTTTCCTTGGACCCCCTATGGTGGGGG CAAAACTTTCTTTGGCCTTAATGGGAGCCCATCAACTTCAACTGCTCGTGGCTTCTTTGCCCA CATGCTTTTCCCCTGAAAAAAATGGAGGGCCGGCCCTGACCTGGCCTCACAATGAAACTAAA | SEQ ID NO: 2315 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| PRF1 | ADXCRAD_A1445650_at | TTATGGGCCCTTTATAAAGCTATGTACATGGGGAAACAGGTCAGGACAGGCCTCCTTTTGTTT AAGGGGCAAAGCATTGGGGGCAAAAAAAACAAACCAGTTGGAGCTGATGGGGCTCCAGTTAAG GCAATGAAGGCTTTGCCACACCATAAAGGGCTCAGGGGAAGGGTCCTAAAAAACCACCCCTGA GCAGCCTGGGGGAACAGCCTTTTGGCCTTCTGCCCAGCTCCTGGCTGAAGCTGTGATCTGTG TACCTGTGACTGCAGGGCTTGAAAATGGCGGAGGGCTTAGGCAGT | SEQ ID NO: 2881 |
| PRKCQ | ADXCRAG_NM_006257_at | CTGTTTGCAGCAGTCAATTGAGTTGAATTAGAATTCCAACCATACATTTTAAAGGTATTTGTG CTGTGTGTATATTTTGATAAAATGTTGTGACTTCATGGCAAACAGGTGGATGTGTAAAAATGG AATA | SEQ ID NO: 1032 |
| PRKCQ | ADXCRAD_AA234512_s_at | AAGGTTTGCTAGACACCTTCGCTTGTTATCTTGTCAAGATAGAAAAGATAGTATCATTTCACC CTTGCCAGTAAAAACCTTTCCATCCACCCATTCTCAGCAGACTCCAGTATTGGCACAGTCACT CACTGCCATTCTCACACTATAACAAGAAAAGAAATGAAGTGCATAAGTCTCCTGGGAAAAGAA CCTTAACCCCTTCTCGTGCCATGACTGGTGATTTCATGACTCATAAGCCCCTCCGTAGGCATC ATTCAAGATCAATGGCCCATGCATGCTGTTTG | SEQ ID NO: 1033 |
| PRPF3 | ADXCRAG_AF016370_s_at | GCATGGGGCTGAACACTACTGGGACCTTGCGCTGAGTGAATCTGTGTTAGAGTCCACTGATTG AGACTACTGCAAGCCCTTGCCTCTCCTCCCTTGCCTTTGTCTCTTCAGTCCTCTCACTTATTC TATTTCCCAACCCCCTCCCACTTGTTTGTGTGATCTCAGAACTGTGCCAAGCAGACACTGGGA CAAAGGGAGAATATCTTGCTCCCCTCCTGAGTCAGCCTGGTGTTGCCCTTTATTCCCCTTATG TGCATA | SEQ ID NO: 844 |
| PRPF3 | ADXCRAD_BG680099_at | ACCTAGCGGACGTCTCTCTATAAAAGCGAGAGTGACGCGCCCGGTGTAAAAACCAACGCACGG GGACAGCAGAGACAAACTATGTCTCCTAGTGGTGCATCACCTTTGAGAAGGAACACACATCAT ACGGCGTGGCGGAGACACACATATAGGAAACCACCCCTCAACGCAGGTAATAAGTGGCCAGGA GGGAACATATACAGCTCGTGAGAGGCATATTAGGGGAGCAGCCGACCCCGCTACCCTCTGCCC GGCGTCAAAAATTATCCATGGCGGATTCTGTGAACTCA | SEQ ID NO: 2389 |
| PSMB10 | ADXCRIH.3674.C1_at | TCGCGGCCCGTAGATAACGCGTGTAGCTCCATCTTGGACGCCACCATCCGTGTGGTCATCTCG GCGTCCGCGGCTACTCCAGCCCCACAGCAGTAGATTTTGGGGGCGATGAAGTGGATCTTCTCG CAGCTCTTGTCCGCCACGACCGAATCGTTAGTGGCTCGCGTATCGGCGCCCAGAATGACCCCC GTCTTGGAACACCAAGCCCGCGATGGTGGTCCCGGTCTTGCGTGCGTGAAGGGACCTTGAGCC CCGGGAGGACGCGTTCCAATGATCATTTT | SEQ ID NO: 1114 |
| PSMB10 | ADXCRIHRC.3674.C1_s_at | TCACCGCCGGGATCTTGGGTGACCTGGGCTCCGGGGGCAATGTGGACGCATGTGTGATCACAA AGACTGCGCCAAGCTGCTGCGGACACTGAGCTCACCCACAGAGCCCGTGAAGAGGTCTGGCC GCTACCACTTTGTGCCTG | SEQ ID NO: 1307 |
| PSMB8 | ADXCRAG_557528_s_at | CTGGGCGGTCATGGCGCTACTAGATGTATGCGGAGCCCCCCGAGGGCAGCGGCCGGAATCGGC TCTCCCGGTTGCGGGAAGCGGGCGTCGCTCGGACCCAGGACACTACAGTTTCTCTATGCGATC TCCAGAGCTCGCTTTA | SEQ ID NO: 1082 |
| PSMB8 | ADXCRIH.1957.C1_at | TCAATCTGAACGTTCCTTTCTCCGTCCCCACCCAGGGACTGGAAGAATTCTGTGGGCTCCAGG CCCGGGCATCCGCTGGAAACAGGGGTGGGTAGGGTCGTGTCATCTAAAGGCCGCAGCTTCAACC AGAAGACTAGAAGTCAGCCAGGAGCTGGGAGTAGTGTCACGCGGGGTGGGGGTTCCTATGAGC ATCACTTTACAAAACCAGGAGGGACGGAAGTGCGAGGGGGCAGAGTCTTGGAAACAGGTCCTG GGCCAACTGCAACAGAATATACCCGCCGCGTGTA | SEQ ID NO: 2244 |
| PSMB8 | ADXCRIH.1957.C2_at | GAGGCGTTGTCAATATGTACCACATGAAGGAAGATGGTTGGGTGAAAGTAAAAGTACAGATGT CAGTGACCTGCTGCACCCGTACCGGGAACCAATCAA | SEQ ID NO: 2245 |
| PSMB8 | ADXCRIH.1957.C2_s_at | TCTCCACGGGTAGTGGGAACACTTATGCCTACGGGGTCATGGACAGTGGCTATCGGCCTAATC TTAGCCCTGAAGAGGCCTATGACCTTGGCCGCAGGGCTATTGCTTATGCCACTCACAGAGACA GCTATTCTGGAGGCGTTGTCAATA | SEQ ID NO: 2246 |
| PSMB9 | ADXCRPD.891.C1_at | CCGGCAGCACCTTTATCTATGGTTATGTGGATGCAGCATATAAGCCAGGCATGTCTCCCGAGG AGTGCAGGCGCTTCACCACAGACGCTATTGCTCTGGCCATGAGCCGGGATGGCTCAAGCGGGG GTGTCATCTACCTGGTCACTATTACAGCTGCCGGTGTGGACCATCGAGTCATCTTGGGCAATG AACTGCCAAAATTCTATGATGAGTGAACCTTCCCCAGACTTCTCTTTCTTATTTTGTAATAAA CTCTCTAGGGCCAAAA | SEQ ID NO: 1618 |
| PSMD11 | ADXCRIH.2540.C1_at | CCACGTCGGCCTTGGAGAGTTTGATGAGACTAGATATGTGTTCAATCTGTACTCTGGAAAAAG GCTCAATGACTCGGATCAGATTCTGTTCAGTAAGTTATCATACAACTTGGCCAAGTGTGTGC TGATGATTGGGTCATCCCGGAGCTCTGCCCGGTAATCTGTCAGAGCCTTTTCAAAATCTGCCA GTGATCTGTTCTTGCTAGCCCTGAGCTCACGCATTTTAATGCTTTCTGTCTGCCTCCCTGCAT ACCGAATGCAAG | SEQ ID NO: 1210 |
| PSMD11 | ADXCRIHRC.2540.C1_at | AGCTCTGTCTTTTGCGTGTCGAGACTGAAAACCTCCTCCTGGTGTCCTCATGGCTTCCTGATT GACACTGCTCTGT | SEQ ID NO: 1322 |
| PSMD11 | ADXCRIHRC.2540.C1_x_at | AGCTCTGTCTTTTGCGTGTCGAGACTGAAAACCTCCTCCTGGTGTCCTCATGGCTTCCTGATT GACACTGCTCTGTCTTCTCTTGCAGAGTTGGATCTGTAGCGGTCCTTTGGAGAGTGTGTGTGG | SEQ ID NO: |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| | | CGGGAGAGTGAAACCTTGGGGGAAAATGCTAGGAGATTCTTTTTTCTTTTTGTTCTACTTTTC GCTCGGAAAGTTTTTAAATCCTCATTTGGTGCATCTGTATTCCAGCCAATAGGTGTGCCAGTT TTCATGTAATCTTTACTGGCCCAACTTG | 1323 |
| PSMD11 | ADXCRPD.139.C1_at | GGACCGGGGCAGAATTAACGTGCAAAGAAATGGGTTGGTGAAGTTTTCTTTACAGGCCCTTTC CGGGGCGGCCCGCTGGAAGACCCCTTCCGCCAACACGGGCTCTTCAACGGAAGCCCGGGAAAT CGCCCGCGGGCGCATTACCACACGCCCGCCGCCGCGCGCATCCGCATATATAAATACTCTGGC CCCCAGAGGG | SEQ ID NO: 1903 |
| PTPN2 | ADXCRIH.138.C1_at | GCAAAGCAAGACCTGAAGCCCACTCCGGAAACTAAAGTGAGGCTCGCTAACCCTCTAGATTGC CTCACAGTTGTTTGTTTACAAAGTAAACTTTACATCCAGGGGATGAAGAGCACCCACCAGCAG AAGACTTTGCAGAACCTTTAATTGGATGTGTTAAGTGTTTTTTAATGAGTGTATGAAATGTAGA AAGATGTACAAGAAATAAATTAGGAGAGATTACTTTGTATTGTACTGCCATTCCTACTGTAT | SEQ ID NO: 1199 |
| PTPN2 | ADXCRPD.12103.C1_s_at | CGGCCCTTGCGCCTTTCTAGCATAAAGTGGTGTGTCAGAGCCACTGTCTCCACAGAAAGCACC ACGTTTGTTTCATTTGACTTATTTGAACCCGTTTCTCCTGCCTTTGCCTTTTTAAATAAAAAT AGCAAAAATTGATTCAAGTGAATCTATTAGAATTTTCTAAAATGGAGCCCATTTGTCTTTTCA GTCTTGCAAGTAAAGTCTTTAAAACAATTAAGCCTCCCAATGATTTAACCGTATT | SEQ ID NO: 1509 |
| PTPN2 | ADXCRPD.2533.C1_at | CAGTATTACACAGTGGGAGGTCCAAATTGGATTAGACTTTGGCATTGAATTCCAAAGTATTGG TAAGTCTAGCACATACTATAAAGGCTTTGCTAAATTCTGGTGGGTACATTATTTTTAAAACCT GTCTGTCTGTCGGTATCACACAGAGGTCACTTCTTGAGTAAAATAAGATGACCTTAAGAATTC ACATAATTCTTGAAGAAGAATATAAGTCACGATGCTTCCACATGAGGCCGCGTCACACCACCA TCGTTTGGAAATCCAGCACCTCAGCCGT | SEQ ID NO: 1523 |
| PTPN7 | ADXCRAG_NM_002832_s_at | GGAGGAGCTGCTCCTTCCTTACAGCCTTGGGGATGGACTTGCCCACACCTCCACCTCCCCTGA GCCCTGTGAGAGGCACGACTGTCTATGCCAATGAGGCTCGGTGGGGGGCTCTCAAGTGCCTGA TCCTGCCCTGGGCTCAGAGCCAGCCCAGAGGGAAGCAACTGCACAGCCCCACAGGCCCTCCCT GGCACTGTCCCCCCAACCCCATCTCAGAGCTCAGAGGGTACAAGCTCCAGAACAGTAA | SEQ ID NO: 1019 |
| PTPN7 | ADXCRAD_BG388017_x_at | TGAGCCCTGTGAGAGGCACGACTGTCTATGCCAATGAGGCTCGGTGGGGGGCTCTCAAGTGCC TGATCCTGCCCTGGGCTCAGAGCCAGCCCAGAGGGAAGCAACTGCACAGCCCCACAGGCCCTC CTTGGGCACTGTCCCCCCAGACCCATCTCAGAGCTCAGAGGGTACAAGCTCCAGAACAGTAAG CAAGTGGGAAAATAAAGACTTCTTGGATGACTGAAGACAAAAAA | SEQ ID NO: 2705 |
| PTPRC | ADXCRAD_BM795677_s_at | GTTTTCAATTTTGCATGCTCGATTATTCCCTGTACAATATTTAAAATTTATTGCTTGATCTTT TTGACAACAAATTAGGTTTTGTACAATTGAACTTAAATAAATGTCATTAAAATAAATAAATGC AATATGTATTAATATTCATTGTATAAAAATAGAAGAATACAAACATATTTGTTAAATATTTAC ATATGAAATTTAATATAGCTATTTTTATGGAATTTTTCATTGATATGAAAAATATGATATTGC ATATGCATAGTTCCCATGTTAAATC | SEQ ID NO: 1020 |
| PTPRC | ADXCRPD.12778.C1_at | TAAGCCTGTATGTACTTTGTTGTCAGCAACTTCTAGGTCTTTCTATCTTTGCCACTTCTAGTT CTTCCTCTCTTACATATGTTACATATGCACATATGCATGTGCACAATCACTGGTATGAATGCA AAGTCAAAGAGAAATATAAAAACAGCTTATTTTCCAAACTGCTTTACTAAGCCCTCTGCAA AGTTTTAGTTCTTTCTGCTCAGATTTATGAAATAAAAACTTCCTGTGTTAAATGTCAAAAAAG TCCAGCAAGATAGCCTTGATT | SEQ ID NO: 1632 |
| PTPRC | ADXCRPD.12952.C1_at | TTCATCTGAATCATGCTCACTCTCTTTACTCATTTCCAGCTCATGTTTAAGTGGCACTCTGTT ATAGTCATATGGGATGACATTAGAATTCCTGTTTTTACTTTTATTTTCTTCTTGATTTCCAAT GTGCTGTGTCCTCCAGCTCCTATATGAAGGAAGTCTCTGGAATTCAGCCTCTAGTGGAGACGG CTCACTGGGTGGATCCCTTTTCTTCATGTTATGTAGATATGGATGTAATTCAGACAAATTCAC TTCTGTTTCTCCAAACTGATTGTATTCCACCAAAGCCTGAGT | SEQ ID NO: 1675 |
| PTPRC | ADXCRPDRC.12952.C1_at | TGCTGCTCAGGACCACTGATGGACGAAGACTTC | SEQ ID NO: 1998 |
| PTPRC | ADXCRPDRC.12952.C1_s_at | GAGACTTCCTTCATATAGGAGCTGGAGGACACAGCACATTGGAAATCAAGAAGAAAATAAAAG TAAAAACAGGAATTCTAATGTCATCCCATATGACTATAACAGAGTGCCACTTAAACATGAGCT GGAAATGAGTAAAGAGAGTGAGCATGATTCAGATGAATCCTCTGATGATGACAGTGATTCAGA GGAACCAAGCAAATACATCAATGCATCTTTTATAATGAGCTACTGGAAACCTGAAGTGATGAT TGCTGCTCAG | SEQ ID NO: 1999 |
| PTPRC | ADXCRAD_BX436427_s_at | AGGGTCAAACTACATAAATGCCAGCKATATTGATGGTTTCAAAGAACMMAGGAAATACATTGC TGCACAAGGTCCCAGGGATGARACTGTTGATGATTTCTGGAGGTGATTTTGGKGAWCWKAAAG CCTTWGTTATTKTCATGGTCACTCGATGTKAAGAAGGAAACAGGAACAAGTGTGCAGAAACT GGCCGTCAATGGAAGAGGGCACTCGGGCTTTTG | SEQ ID NO: 2535 |
| PTPRC | ADXCRAD_BG546180_s_at | GAAAATAGGGTATACAGTGGATTAATTAAATGCAGCGAACCAATATTTGTAGAAGGGTTATATT TTACTACTGTGGAAAAATATTTAAGATAGTTTTGCCAGAACAGTTTGTACAGACGTATGCTTA TTTTAAAATTTTATCTCTTATTCAGTAAAAAACAACTTCTTTGTAATCGTTATGTGTGTATAT | SEQ ID NO: 2636 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| PTPRC | ADXCRAD_BC031525_at | ATTACTGTACTTAGTTGGCTATGCTGGCATGTCATTATGGGTAAAAGTTTGATGGATTTATTT GTGAGTTATTTGGTTATGAAAATCTAGAGATTGAAGTTTTTCATTAGAAAATAACACACATAA CAAGTCTATGATCATTTTGCATTTCTGTAATCACAGAATAGTTCTGCAATATTTCATGTATAT TGGAATTGAAGTTCAATTGAATTTTATCTGTATTTAGTAAAAATTAACTTTAGCTTTGATACT AATGAATAAAGCTGGGTTT | SEQ ID NO: 2797 |
| PTPRCAP | ADXCRPD.5068.C1at | CCCAACCACAGGCATCAGGCAACCATTTGAAATAAAAC | SEQ ID NO: 1645 |
| PTPRCAP | ADXCRPD.5068.C1_x_at | ACCACAGGCATCAGGCAACCATTTGAAATAAAACTCCTTCAGCCTG | SEQ ID NO: 1646 |
| PTPRE | ADXCRAG_BC050062_s_at | ACAGTAGAATAACCACGGGCAATTAAACTTTAAATTTTCTGAGCAGCATTTTGGTATTTAAAC ATTTCTTGTAAAAAGCTGAGACAGTTTGTAAGAAAAGAATCCTTAAAATCTAGATTTATACCA TTTTTTAAAGTCCCACCTTTCAATGTTTAATAAAACAAAAAGAAATCCTTAATCTAAAAGCTA AATTATTTTTGAATGGAAATACTACTGAGACCATTGACACTGGATAACAGTAATGATCCCATT ACCA | SEQ ID NO: 970 |
| PTPRE | ADXCRAG_NM_006504_at | AACCTTTACTTTGACTACCAGCCTGTGTTTTT | SEQ ID NO: 1035 |
| PTPRE | ADXCRAD_BM725213_s_at | TTTAAATGAGCCTGACACCTGTGTTTCAGCATTTGGAGACATCCCCATGTTATTCTTTTAAGT GTATAATTACTGATACTTTTTGTTTGTTTGTTTAACTAAGTTGTGTTTAACTTATGTGCAGT CTTTATAATGTATGTTATTACAGTTTCAACTATCATATTTTCTTTGATTACATTTATAA TTTGATCTTGCTCTGATTATAATGCCAGTGAATGTTGCTGAACTCTTTGTATATGCAAATTGC AAGATTTAAACCATTCTGATGCAAGGATAAACCT | SEQ ID NO: 1036 |
| RAC2 | ADXCRAG_BC001485_s_at | AATTTTCTACGCCTCTGGGGATATCTGCTCAGCCAATGGAAAATCTGGGTTCAACCAGCCCCT GCCATTTCTTAAGACTTTCTGCTCCACTCACAGGATCCTGAGCTGCACTTACCTGTGAGAGTC TTCAAACTTTTAAACCTTGCCAGTCAGGACTTTTGCTATTGCAA | SEQ ID NO: 914 |
| RAC2 | ADXCRAD_CV027630_s_at | AAACCGTGTTCGACGAGGCCATCCGGGCCGTGCTGTGCCCTCAGCCCACGCGGCAGCAGAAGC GCGCCTGCAGCCTCC | SEQ ID NO: 2461 |
| RAP1B | ADXCRIH.1784.C1_s_at | ACCTGAGAGAACAGATTCTTCGAGTTAAAGACACTGATGATGTTCCAATGATTCTTGTTGGTA ATAAGTGTGACTTGGAAGATGAAAGAGTTGTAGGGAAGGAACAAGGTCAAAATCTAGCAAGAC AATGGAACAACTGTGCATTCTTAGAATCTTCTGCAAAATCAAAAATAAATGTTAATGAGATCT TTTATGACCTAGTGCGGCAAATTAACAGAAAAACTCCAGTGCCCGGGAAGGCTCGCAAAAGTC ATCATGTCAGCTGCTTAATATACTAAATGCATTGTAGCTCTGA | SEQ ID NO: 1133 |
| RAP1B | ADXCRIH.1078.C2_at | GCTCTTTGGACTTTCTTTTATTATGCTAAAATAGTGGTGCTTTTAGGATTTACATTATTGTAC TCTCCAATACAAAGTATGGGGCATGTTAAAGTATACAGTACACCATTTTCATACATGTACAAC ATTGGTGGATGAAGAATGTCTCTTAGCAGTAATACTGGAGGTAGCCCTCGTGCCGA | SEQ ID NO: 1303 |
| RAP1B | ADXCRIH.1078.C2_x_at | AGCGAAGTTATCTGGAGTAGTCTATATAGGAGCTCTTTGGACTTTCTTTTATTATGCTAAAAT AGTGGTGCTTTTAGGATTTACATTATTGTACTCTCCAATACAAAGTATGGGGCATGTTAAAGT ATACAGTACACCATTTTCATACATGTACAACATTGGTGGATGAAGAATGTCTCTTAGCAGTAA TACTGGAGGTAGCCCTCGTGCCGA | SEQ ID NO: 1304 |
| RAP1B | ADXCRIHRC.1078.C2_s_at | ATATGTAATTGGTCACAAGGCCTAATTTGCAGTAACTATTGCTGTTTTATTTAACAATGCCTT GTTGCTTTGTATGCATTAATGTTTGGATGTAAAGATTGTGTGTCTATCCAACAGGGAGCCACA GTATTTAAATTGACCAACCTAATGTTACAACTACTTTGAGGTGGCCAAATGTAAACTAAAAGC CTTAATTAAAGTGGTGCAATTTTGTATAACTTAGCATCAGTAGTTCAATAAATTTGGATTGCC ATGCAAGGGCTTG | SEQ ID NO: 1336 |
| RFTN1 | ADXCRAG_BC032349_s_at | ATCGGGACTGGCTGGCGCCCTTGTTATGTGCTATTTTAATCAGTGTAACATTGGTCAAGTTGT TACCCATGTATGCTGTGTTTATCATGTGTATATCGTCCAGAAAGTATTAAGGCTTTAGGTAGA TGCAACTGGCGAACCTTGGAGAGGGAATGCTGATTGTCTTGACCAAACCCACAGC | SEQ ID NO: 954 |
| RFTN1 | RDCR221_B10_at | GCAAGTATGCCGTTCTGGTGAAGATCATGGGGCAAAGTGAATTTTGATTCTTGAGTTTCTGTG GGCCAGAAATCCAGGTGGGCTGAACTGGGTCGTCTGCTGCTTTAGGGTCTCAAAACACTGAAAT GGGATGTCAGCAGAGCTGTGTGCCTTATTAGAGGTTTTGGTGGGGAAGAATCCACTTCCAAGC TCACTTAGGTTGTTGGCCTTGTGGTTGCAGGTCTGAGGTCCTTGTTTTCTTGCAGGCAGTTAT CCAGGAGCTGGTCCTTGCTCCT | SEQ ID NO: 1346 |
| RFTN1 | ADXCRPD.13500.C1_at | GAAAACTGAGTCTTACACAATGAAGTGCTACATCTTGGACATTAGACTGCTTGTTCCTCCATT AGAGCAGCCGACTGACCAGTAAATCAATCCAAGAGTTCAATAAGGAAAGATACAAGTGAGGCT AGCAAACGCCCAAGAGACTGAAAATACAGTGGGGTGGTAATACCTCAAGAAACCAAACCTCAT GTGAACTAGGGAAGCAAGCAGTGCTCCAGGTGGTCTACTGACAACAAGACCGGAGGATGCACA AAGAAGATAAAACGCACGTGGCGACTCACCAG | SEQ ID NO: 1659 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| RFX5 | ADXCRAG_AL050135_s_at | AAGCAGTAAACCAACTAATATTTATTGAAGACCTACTTTGTCCTCTACATAGGGTAGCTTCTG TCAGGGAATCTTGGTTCTTCCCAAGAAACACTGATTTTCTTTCAGGGAGACTTCATGTGTTCA TTTATTTCCACCACAGCAGATTTTAAGAAATTATAATATGTAATATTTGATATCTATAAGAG TATATCTAACGTGAATAAATTATGAAGCATACTAATGAGTACCTATGACCCATAACACATATA CATT | SEQ ID NO: 886 |
| RFX5 | ADXCRPD.5339.C1_s_at | AGGACCATTTAAGTCTGGGCCACTTAATGGCTGCCAGCATTCCTAAGATTACACTTTTCCCCA TTTATGTCCAATCAGAAAAGAAGGCATCTTTGTACCAGAAATCTCAGCAAAAGCCCTAATAT TCACACTGATTAGGCCTGGGTCACATGTCCACCCTGACCAATCACTGTGGCCAGGAGGATGAT ACATGCTA | SEQ ID NO: 1694 |
| RFX5 | ADXCRAD_BI256444_at | CAAGGGATTCTCATGGTTCATGTGACTTAGAAAGTCCATAGGTAAGTGCTGGCTCCAGGTGAA GCACTTGAACCAGTAGTTCAGTATGTCTCTAAATACCGGACTGACTTTTTTCTCACTGTTGCA TCTTCTGTAGGACCACTTAAGTCTGGCCACTTAATGTTGCACATTCCTAGATTACCTTTTCC CA | SEQ ID NO: 2403 |
| RFX5 | ADXCRAD_BI256444_x_at | TTAAAACTACCAAGGGATTCTCATGGTTCATGTGACTTAGAAAGTCCATAGGTAAGTGCTGGC TCCAGGTGAAGCACTTGAACCAGTAGTTCAGTATGTCTCTAAATACCGGACTGACTTTTTTCT CACTGTTGCATCTTCTGTAGGACCACTTAAGTCTGGCCACTTAATGTTGCACATTCCTAGAT TACCTTTTCCCA | SEQ ID NO: 2404 |
| RHOG | ADXCRIH.1986.C1_s_at | ATCACACCGCAGCAGGGCCAGGCACTGGCCAAGCAGATCCACGCTGTGCGCTACCTCGAATGC TCAGCCCTGCAACAGGATGGTGTCAAGGAAGTGTTCGCCGAGGCTGTCCGGGCTGTGCTCAAC CCCACGCCGATCAAGCGTGGGCGGTCCTGCATCCTTCTTGTGACCCTGGCACTTGGCTTGGAG GCTGCC | SEQ ID NO: 1225 |
| RHOH | ADXCRAD_BM919440_at | ATCCCTTGGGGGAACTGGTGATGAATAATTCCATCTTTGGATTAAAAAAGTGAAAATAGTCTC CCATAATTTTTGGGACCAATGAAGTTGAGT | SEQ ID NO: 2435 |
| RHOH | ADXCRAD_BM919440_s_at | GGATACAGTTATTGATGAGGCTTGGCCACTGGATGTTTTCACTAACTACACTCTACAAGTGAA CTCCTTGCCCAGGCCAGTTAGAAAATCCCT | SEQ ID NO: 2436 |
| SAMSN1 | ADXCRAD_CD522843_s_at | GAGGATTCGCTGTTGAAACAAGTTGTCCAAGCAATGTTATATTCATTTTTATACTTATTGGGA AAGTGTGAGTTAATATTGGACACATTTTATCCTGATCCACAGTGGAGTTTTAGTAATTATATT TTGTTGATTTCTTCATTTTGTTTTCTGGTATAAAAGTAGAGATAATGTGTAGTCACTTCTGAT TTAGTGAAACCAATTGTAATAATTGTGGAAATGTTTTGTCTTTAAGTGTAAATATTTTAAAAT TTGACATACCCTAATGTTAAT | SEQ ID NO: 872 |
| SAMSN1 | RDCR115_B08_at | ATTGCTAAAATATGTGTCTATTAAATCAATGTACTCAATGTACATCTCTGTGGAAATCTTCTC TCTGTACCTAACCTCTGATATGTTTTCTGAAGGATGAGG | SEQ ID NO: 1344 |
| SAMSN1 | RDCR115_B08_s_at | GATGGAGAGAATGCCCACCCATATAGAAACAGTGACCCTGTGATTGGGGACCCACACAGAGAA AGTGTCCCTCAAAGCCAGTGACTCCATGGATAGTCTCTACAGTGGACAGAGCTCATCAAGTGG CATAACAAGCTGTTCAGATGGTACCAGTAACCGGGACAGCTTTCGACTGGATGACGATGGCCC CTATTC | SEQ ID NO: 1345 |
| SAMSN1 | ADXCRPD.2125.C1_at | CCCAAACCGCCTCCATTATTTGAAGTTTTACTTTGTTCTCCACTTCCATTTGTGGGATCTCCT TCATGTGCCTCAGTTGAATCATCTGGTTTTGATAAAGAATTATTCCGAAAACGATCGAAATTC CCAAAACTGCTGCTTCGCTTTGGTTTTTGATGTTTCTCCTTCTCTGAAACATTGGATGGCTTT CTCTTGAGCATTTTGAATTCTGACTACTCCTAGTGAGTGCACTTTCTGCTGT | SEQ ID NO: 1429 |
| SAMSN1 | ADXCRAD_BU198472_s_at | TTATCACAGAGCCAAGTGACTGAACACGCATTCCCAACTATATATCTACAGATGCATTCCATT TTAACTCTTCTTGAGCTAAAACGTCAAATAGGAGAG | SEQ ID NO: 2323 |
| SAMSN1 | ADXCRAD_BQ082118_x_at | AGTTATTTTACTCATGCTGTGTTTTTAATATAAGCTTTACAAAAAAAGATGCATTCCCTTCC TGTTCACACTCTTACCATGTTTTTGTTCTTCCTTAAGAATGATTTGTGTGTGTGTGTGTG TGTGTGTGTGTAAGTGTAACATCATGGGTTTCTTTCTTCACTTGTAAAGTTTTATCTAGAAA TACTTTTACAGGTTATGTTGAGGTACACAAAGATAATGTTCTAAGATTGTGTATTGGATT | SEQ ID NO: 2448 |
| SEC31B | ADXCRAG_NM_015490_s_at | TGCCCTTGACTCCACCTATGTTGGAGCCTTAGCCCAAGGCCATTCCTTCTGTGATGATAAAGC CCAGTTCTGGAATTGGAGCCATATTAAGGAATGATTCTCTTCCAGCGCTGCTCCTCAAGGGTT GGGGGTCCTTCTCCCTCGCAGCCACCACATGTCTCAGGGCTACCTTCTCCGATTGGATTTGCA TTTGTGGCACTGTCTTTGATGCAGTGATGTACTTAA | SEQ ID NO: 1045 |
| SEC31B | ADXCRPD.17780.C1_at | AAAGCAGGCACTCAGCTGGTTTTGGAGCCAAGCCTACAGCATCACATACCTGGCAGCAAGGAA AAGAGTCGGGAAAAGAAACAGAATCTGTTGCAGAAGTCCCCCTCTTCTGCAGGGAGGAGTTA TGTAACAGCAGAAGTGGCCTCCTAGCAAGAGAGGCTGCTGGTTTAGACCAGCAGCTTATGAG CGATGATGAGGACAGCCTTCAGGATAGGCATGAAGCTGGACACCTCGCTGAAGCTGATACA | SEQ ID NO: 1424 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| SEC31B | ADXCRPDRC.17780.C1_at | CTGCTGTGACCATCATGTGGTCTTTGTTCTCCTTCTGTCGTCTTCTCGGATCCTCTAGATC | SEQ ID NO: 1929 |
| SEC31B | ADXCRPDRC.17780.C1_s_at | AAACCAGCTGAGTGCCTGCTTTTTACTCCTTTTATGTCTGGCCTTCTAGGATCTGGTCCAAGA CACTCTCAGGGCCTGGGAGGCAGGGCATAGAAATCAGTTCTTCACTCTCCCTAATACTACACT CTGTAAGGACCTGGGGCAGGATATCTTCTCCCCCCAGGGGATCTTCTATTTAAGTTGGCTTTTG AGAGGGTGAACAGGATTGTTACTTTTAAGCCTACCTCTG | SEQ ID NO: 1930 |
| SELPLG | ADXCRAG_AY331789_at | GTCTCTCATTAACAGCCAGTAGCTTATTGGTGATCCTAGATGCAGCCTGCAACCTTTTGTACA ACTCACAGAAGCACTGATTTGCTGTCAAATGGTGGAAAAGTTCAAGCTGCCAAACTTTTTCTT AAAGGACCAAACAGTGAATACTGTAGGCCTTAACTGTTGCAACACCATAGCCTCTGTTGCAAC AACTCAACTCTGTCCTTGTAGTACA | SEQ ID NO: 906 |
| SELPLG | ADXCRAG_U02297_s_at | GGGCAAGTGGAGCCACCTCTTTCCTCCCTCCGCGGATGAAGCCCAGCCACATTTCAGCCGAGG TCCAAGGCAGGAGGCCATTTACTTGAGACAGATTCTCTCCTTTTTCCTGTCCCCCATCTTCTC TGGGTCCCTCTAACATCTCCCATGGCTCTCCCCGCTTCTCCTGGTCACTGGAGTCTCCTCCCC ATGTA | SEQ ID NO: 1059 |
| SELPLG | ADXCRSS.Hs#S2980215_s_at | GCACACTCAGTGACTATAAGCTTCCTGAGAGCAGGGCTGTTCTGAAGAGATTTGAGTTTTCTC CTGGCCATGGAGAGTGTAATTAAGTAGCCCTGGGCCTTGAAGACTTATAGTGCAGGTTGACT GAAAGAACTAAATCAGCCAGTCTTTGCGGAGAGGTTGTCATGCAAACGAAGTGCTAAGGGTCT TGCATGCATCCCTTCATTTTATCCTCACAATAGACTGTGAAGTAGGCACCGCCATCCCTGTTG TGCATTGTGCAGGC | SEQ ID NO: 2144 |
| SELPLG | ADXCRAD_BI818193_s_at | GGGCAGCTTGGGTCTTCTTGGGCACCTCTCTGGGAAAACCCAGGGTGAGGTTCAGCCTGTGAG GGCTGGGATGGGTTTCGTGGGCCCAAGGGCAGACCTTTCTTTGGGACTGTGTGGACCAAGGAG CTTCCATCTAGTGACAAGTGACCCCCAGCTATCGCCTCTAGCCTTCCCCTGTTGGCCACTTTC CAGGGTGGACTCTGTCTTGTTCACTGCAGTATCCCAACTGCAG | SEQ ID NO: 2500 |
| SERPINA1 | ADXCRIH.3253.C1_s_at | TACTGGAACCTATGATCTGAAGAGCGTCCTGGGTCAACTGGGCATCACTAAGGTCTTCAGCAA TGGGGCTGACCTCTCTCGGGGTCACAGAGGAGGCACCTCTGAAGCTCTCCAAGGCTGTGCATA AGGCTGTGCTGACCATCGA | SEQ ID NO: 1259 |
| SLA | ADXCRPD.8133.C1_at | AGGCTAAGAAGTCCTTTGGGCTAATGTTTAGGGTCACGAAGTTCCTTTAAAAAGAGAGGAAAG CATACCAAAAGTCCCTATGGATTAGTTAAAGTAGTTCCATTCAGGGCACCCATCTGCAAACCC AGACCTTCTGCCAGGACACAGCTTTTGTTTCCTCTCCCTCTCAGGCTTGCCATACAGAAGTTC TCTCCAATGACCTTGGAGTGTAACTGTCTGGACAGGTCCAGTTCCTTGGAGAGCAGTCCTGGT GCCCCTTCCTGTGAGAGTGGGCTTGTCCC | SEQ ID NO: 1807 |
| SLA | ADXCRAD_AL548133_s_at | AAAGGAACCAGCCAACGTATGAGAAATGAATGTAACACTGTGGACATTGACTTCCCGCATAAG GCAGGGTGACCCCCTGAACTCCAGATGTCTGCACAGTATCTTATGTGTTGTTTTCCGTTGTGA CGAATGTGATTGGAAC | SEQ ID NO: 1866 |
| SLA | ADXCRPDRC.8133.C1_at | CATTAAGTCCTCTGTAAGGTGTCAGGCAAGCCNNNNNNNNNNNNNNNNNTGGGTAAGTCCTAAC CCCCCACAAAGGTGTTCCCAGTGACTACCT | SEQ ID NO: 2026 |
| SLA | ADXCRAD_BX436824_s_at | ACCAAAGCCATATGGGTGGAAGTCAGTTGGCCTCCCTGGTTCTGCAGAGGGCCAGAAGAATGA GAGAGAGGAAGACTGCTGGCAGGGAAATCGAGGAGGCGAGACTAGAACTGCACCAGCTTCCCT GATGTCTGCAGCCATGGCTTTGCAGCGCAGACAGACTTCTCTGGGATGCTGGGATTCTTGCC TGTATGAATGCATCAAGTATTCATTTATTGCCCGAATAGGCATTGCATTAAGTC | SEQ ID NO: 2027 |
| SLC16A3 | ADXCRPD.4071.C1_at | GGACCTGTCCCGTAGAGCATGTGCCAGCAGGATGGAGGAGATCCAGGCTGTGTCGCTGTAGCC GATCCCAAACTCCTGTATGAGCTCCTTGAAGAAGACACTGACGGCCTTGGGGAAGGCGTAGGA GAAGCCAGTGATGACGAAACAGCCGAAGAGCACTGGACCAGC | SEQ ID NO: 1575 |
| SLC16A3 | ADXCRPDRC.4071.C1_at | ATATTCGCGCCCCATGGTAGCCAAACACCGAGCACAACCACTCCCCCTCTTGTCGCGGCTCGT ACCACATACCCGTCTCTTACGCGCGCCACAAGCATGAGGNGCTCACGCCCATCTTTTTTGTCC ACCTCCGTGATGAAACCCCGCGCCCACTGACTTTATTAGCGCCCTACGCACTACACATAATTG CCGCCAGCCTGATACCCACACCGCGTCCTNATAGATCACTCGTCGCCCTGTAGCG | SEQ ID NO: 1967 |
| SLC19A1 | ADXCRAG_U17566_s_at | GAAGTACGTCCCAGCGGCCTCAGGGTCTAAGGAGCGCTAGTGCCTTGCCCACAGGTGCGGGAC CATCTGATGTGATGTGAATACTCTTCCCACATACATTAAACACACTTA | SEQ ID NO: 1064 |
| SLC19A1 | ADXCRPD.7962.C1_s_at | GCCGCGGGCTTCGTGAAGATCCGCTGGGCGCGCTGGTCCAAGCTGCTCATCGCGGGCGTCACG GCCACGCAGGCGGGGNCTGGTCTTCCTTCTGGCGCACACGCGCCACCCGAGCAGCATCTGGCT GTGCTATGCGGCCTTCGTGCTGTTCCGCGGCTCCTACCAGTTCCTCGTGCCCATCGCCACCTT TCAGATTGCATCTTCTCTGTCTAAAGAGCTCTGTGCCCTGGTCTTCGGGGTCAACACGTTCTT TGCCACCATCGTCAAGACCATCATCACTTTCATTGTCTCGGACGTGC | SEQ ID NO: 1389 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| SP110 | ADXCRIH.149.C1_s_at | ATCCTCAGTGAAGTGCATTCGGAATGAGGATGGAACTTGGTTAACACCAAATGAATTTGAAGT CGAAGGAA | SEQ ID NO: 1202 |
| SP110 | ADXCRIH.149.C1_x_at | ATATACGTTGTGAAAGGACGACCCTAGGAGAGCTGCTGAAGAGTGGACCTTTGCTCTGTCCTC CAAGAATAAATCTCCAGAGAGAGTTTAAATAGCAAGTGAATTTCTACTACC | SEQ ID NO: 1203 |
| SP110 | ADXCRPD.2201.C1_s_at | AAGCACTTCAGTGACCAATGACAAGTTAACATCCAAAATGAATGCGGAAGAAGACTCAGAAGA GATGCCCAGCCTCCTCACTAGCACTGTGCAAGTGGCCAGTGACAACCTGATCCCCCAAATAAG AGATAAAGAAGACCCTCAAGAGATGCCCCACTCTCCCTTGGGCTCTATGCCAGAGATAAGAGA T | SEQ ID NO: 1456 |
| SP110 | ADXCRAD_NM_080424_s_at | GACTTTGGCCAGGTAGGACTTGACTTAGAGGCAGAATTTGAAAAAGATCTCAAAGACGTGCTC GGTTTTCATGAAGCCAATGACGGCGGTTTCTGGACTCTTCCTTGACCCTGTTCTGTAAAGACT GAAGCATCCCCACCTCAGGATTCAGCTGATGGGACCCTGGCTTGGACTGTTGATTGCCAGTGA GTCTGGGATGTAATTGGCTGCCCTCAGGACCCAAACCCAGACACTTCATAGGATTATCACACC CTCCATCTTTATT | SEQ ID NO: 2760 |
| SP140 | ADXCRAG_U36500_s_at | TCCCATACAGGCTCTTACCTCTTCTCCTGAGGGCTGCTCCAGACAACATTTATTACCCAGAAG ACCTTTTGTCTGAAAACCAGCCAAGCTTTATTCAGGACACACTTCTTGCCTTCACTTTCCCAC TTCCGTGGCCACCTCCATGCAGAAGCCCTAAGCCCACATTCTTTCGATAGCTCACGGTGGTGC ATGAGTGTCCATCATCTGACTCTT | SEQ ID NO: 1066 |
| SP140 | ADXCRPD.734.C1_at | AGCACATACTGGTACCCCTGAGAGGAGCTGCCTGTGAAAGCTATAAAGACAGAAAAANNNNNN NNNNNNNNNNNNCCTTTTCCCGACCCATGGGGTTTAAATTTCCAAACTTGTGGGGAAGGCAAGG CTGATGAAGAACTTGACCTTTTGGAACAAAAGAAAATTGAAAGCGGCATTTCTTGGCAAAGGG TTT | SEQ ID NO: 1605 |
| SP140 | ADXCRPD.734.C1_x_at | TATCATCCAGTGCAGTCCTGGGTCAACTTGTTTCTCCAACAAAGACTGGAGAAGTCACGAAGA GAGCCTAGCACATACTGGTACCCCTGAGAGGAGCTGCCTGTGAAAGCTATAAAGACAGAAAAN NNNNNNNNNNNNNNNNCCTTTTCCCGACCCATGGGGTTTAAATTTCCAAACTTGTGGGGAAG GCAAGGCTGATGAAGAACTTGACCTTTTGGAACAAAAGAAAATTGAAAGCGGCATTTCTTGGC AAAGGGTTT | SEQ ID NO: 1606 |
| SP140 | ADXCRAD_BG757090_at | TGCGCGGACAACGAGGTACAGGACAGGGCCCAGAGCCAAAGCTGGTACCCTGACCCAAGATTC CCGGCCCACAACGGGGATAAACCGGCACGGACCCCATAAAAGAGGAACCAGATAACATCACCA GAAAAGCCAGGGTAAACCGTGACTACAGAAACGCCGAAGAACAAACAGCACGCACAAGCGCGG CAACA | SEQ ID NO: 2707 |
| SP140 | ADXCRAD_BG757090_x_at | TGCGCGGACAACGAGGTACAGGACAGGGCCCAGAGCCAAAGCTGGTACCCTGACCCAAGATTC CCGGCCCACAACGGGGATAAACCGGCACGGACCCCATAAAAGAGGAACCAGATAACATCACCA GAAAAGCCAGGGTAAACCGTGACTACAGAAACGCCGAAGAACAAACAGCACGCACAAGCGCGG CAACA | SEQ ID NO: 2708 |
| STAT3 | ADXCRAG_AY572796_at | GAGAGGAGGTGGTTGCCTTAATCCCCCCCGCCAACCCCTTATGTTAGCCACCAGCCCGGAGG TAAGGGGTGCCTGGAGGAGCAGGAGGTCAATAGTCCAACGGCAGAAAGGTGTCAGAGTGGAGG CCTCCCTCCCCGGCCCCTCCTACCCCCCAGAGCGGCCTCGTCCTGTCTGGGGTCAGATAAGC CACCTAAGCGGGGTGGGGGGTAGATACTCCCACCGCACCAAGGCCTCCCCTTCCACAGTTGGC TCCTTTATCACTTTCCCTTCAGTT | SEQ ID NO: 911 |
| STAT3 | ADXCRIH.2963.C1_s_at | GTTCAGGGCTTCTCTGGAGCAGATATTGTCAAGTTCATGGCCTTAGGTAGCATGTATCTGGTC TTAACTCTGATTGTAGCAAAAGTTCTGAGAGGAGCTGAGCCCTGTTGTGGCCCATTAAAGAAC AGGGTCCTCAGCCCTGCCCGCTTCCTGTCCACTGCCCCTCCCCATCCCCAGCCCAGCCGAGGG AATCCCGTGGGTTGCTTACCTACCTATAAGTGGTTTATAAGCTGCTGTCCTGGCCACTGCATT CAATTCCAATGTGTACTTCATAGTGT | SEQ ID NO: 1233 |
| STAT3 | ADXCRPD.13006.C1_s_at | TAATGGTGAAGGTGCTGAACCCTCAGCAGGAGGGCAGTTTGAGTCCCTCACCTTTGACATGGA GTTGACCTCGGAGTGCGCTACCTCCCCCATGTGAGGAGCTGAGAACGGAAGCTGCAGAAAGAT ACGACTGAGGCGCCTACCTGCATTCTGCCACCCCTCACACAGCCAAACCCCAGATCATCTGAA ACTACTAACTTTGT | SEQ ID NO: 1566 |
| STAT3 | ADXCRPD.15731.C1_s_at | GGATAACGTCATTAGCAGAATCTCAACTTCAGACCCGTCAACAAATTAAGAAACTGGAGGAGT TGCAGCAAAAAGTTTCCTACAAAGGGGACCCCATTGTACAGCACCGGCCGATGCTGGAGGAGA GAATCGTGGAGCTGTTTAGAAACTTAATGAAAAGGTAATTTAGCATCCTTGTCCCTTTCCCTC ATCTAAAAAATACCTAAAAGACTCACGTGGTAGAGTGAGAGGCGGGCTGACTTCTGGTCA | SEQ ID NO: 1783 |
| STAT3 | ADXCRPD.7602.C1_s_at | GGTGTGGTTGCACTGAAGTTAACAAGATTCAAACCGTCGCCCAAGTTGGTATTTCCATGTTTG GTACACATCACTCTGTGCCATATCAGGTCGTTGTTAAGTGTGGTGACAAAATCAGTGGTTAGT CATTTTTTTAATTAAAAATGTGTATAGTGTGTACCTGCTGGTCTTACTGTATGTGCAACTAAA GGTTTACATAGTCTGTGTATGGGTTGTAAATTTTTGGCTGGCTGTGCTGATAAAGCATTGGGC TT | SEQ ID NO: 1827 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| STAT3 | ADXCRSS.Hs#S1751591_s_at | TCAGGATGGTACGTGGTTGCCAGCAGAGAGCTGCTCCTCAAGTGAAGGAGGTAGAATCAAAGC CAATAGGAAAGAGCCTCAGATGCTTATATATGTACCGTGGGGATTCAGAGTGAAAGCAGTCAT TGGACTAGGGGTGGGGTTAGGGAGAGCCTGTCTGACAGACACAAGAAAGGGATGGATACGCCA CCCAGAGAAAAAGCATTTTAGGCAAGAACAAAT | SEQ ID NO: 2108 |
| STAT3 | ADXCRAD_BX409785_x_at | AGAAACTCAGTTACAGCCTCCTTGGTGCTTTAGCATTCAGCTCCCTTCAGCTGGNATTTATAT AATCCTGAAACGGCTTTAGTCCA | SEQ ID NO: 2644 |
| STAT3 | ADXCRAD_AI682905_x_at | AAGAGATGAGGGTTCACTTTGTTGCCCAGGCTGGTCTTGAACTCCTGGGCTCAAGCAACCCTC TTGCCTCCCATCTCCCAAAGTGCTGGGATTATAGGCATCGGCCACTGCACCCAGCTACACACAC TTTTTCACCACCACTCCAGCAAAGTTCTGAACAGAAAATTACCTTTAAAGAGTTTCTCTGTGT CATAAAAATACTTGGCAAAAGGTATTAATAAAATCTGACATACAAGGGATGTAATGACCCTTC AAAATCACTATTCTTATTGCTCGGAAGCGATCAATACATTG | SEQ ID NO: 2872 |
| TACC3 | ADXCRAD_BX107802_s_at | CAGGCGGAAGCGTTGGCCCTCCAGGCCAGCCTGAGGAAGGAGCAGATGCGCATCCAGTCGCTG GAGAAGACAGTGGAGCAGAAGACTAAAGAGAACGAGGAGCTGACCAGGATCTGCGACGACCTC ATCTCCAAGATGGAGAAGATCTGACCTCCACGGAGCCGCTGTCCCCGCCCCCCTGCTCCCGTC TGTCTGTCCTGTCTGATTCTCTTAGGTGTCATGTTCTTT | SEQ ID NO: 1785 |
| TAF1A | ADXCRPD.7472.C1_s_at | CTACATTAAAACATTCTTAGGCCATTGCTTTCTAACTTTTATAGCATCTACAGAAAATTTCAA TAATGTACAGTACACTGAGATAAACAGAGAAAGTTGGCTCCAGCTGCCATCTCCATGTATGTA TCATCCACGCTATCCCCTGCTGCCCGGATGAGACTGAGGAGAGAGGATCAGAAGTCTTGTGCA ACCCTGGTTGGAATACTCTGCACTGATATTTTTTGAAAATCAACTTTATTGAAATTTAGTTTT CAGAGAGTAAACACACTTAT | SEQ ID NO: 1798 |
| TAF1A | ADXCRAD_CN293583_at | AACCACCTTGCGTGGGTTCAAGAAGAGTGGAACTCCAGGAAAAACTGGTGGCCAGGCTTTCAT TTCAGCTACTTTTGGGCAAAAGTGATTGGAAGGAAGATACAGCTTTGGCCTGTGAGAAAGCT TTTGTGGCTGGTTTACTGTTAGGAAAAGGTTGTAGATATTTCCGGTATATTTTAAAGCAAGAT CACCAAATCTTAGGGAAGAAAATTAAGCGGATGAAGAGATCTGTGAAAAAATACAGTATTGTA AATCCAAGACTCTGATACTGAATTTTAG | SEQ ID NO: 2453 |
| TAP1 | ADXCRPD.4854.C2_s_at | CAGCTGCCTCCAGGATGAGTTACTTGAAATTTGCCTTGAGTGTGTTACCTCCTTTCCAAGCTC CTCGTGATAATGCAGACTTCCTGGAGTACAAACACAGGATTTGTAATTCCTTACTGTAACGGA GTTTAGAGCCAGGGCTGATGCTTTGGTGTGGCCAGCACTCTGAAACTGAGAAATGTTCAGAAT GTACGGAAAGATGATCAGCTATTTTCAACATAACTGAAGGCATATGCTGGCCCATAA | SEQ ID NO: 2282 |
| TGFB1 | ADXCRPD.3499.C1_at | GGAAAGGCCGGTTCATGCCATGAATGGTGGCCAGGTCACCTCGGCGGCCGGTAGTGAACCCGT TGATGTCCACTTGCAGTGTGTTATCCCTGCTGTCACAGGAGCAGTGGGCGCTAAGGCGAAAGC CCTCAATTTCCCCTCCACGGCTCAACCACTGCCGCACAACTCCGGTGACATCAAAAGATAACC ACTCTGGCGAGTCGCTGGGTGCCAGCAGCCGGTTGCTGAGGTATCGCCAGGAATTGTTGCTGT ATTTCTGGTACAGCTCCACGTGCTGCTCCACTTTTAACTTGA | SEQ ID NO: 1580 |
| TGFB1 | ADXCRAD_BU782064_s_at | TCCACGGAGAAGAACTGCTGCGTGCGGCAGCTGTACATTGACTTCCGCAAGGACCTCGGCTGG AAGTGGATCCACGAGCCCAAGGGCTACCATGCCAACTTCTGCCTCGGGCCCTGCCCCTACATT TGGAGCCTGGACACGCAGTACAGCAAGGTCCTGGCCCTGTACAACCAGCATAACCCGGGCGCC TCGGCGGCGCCGTGCTGCGTGCCGCAGGCGCTGGAGCCGCTGCCCATCGTGTACTACGTGGGC CGCAAGCCCAAGGTGGAGCAGCTGTCCAACATGATCGTG | SEQ ID NO: 1970 |
| TGFB1 | ADXCRAD_NM_000660_at | TTAAGGGAGGAGTTCCTGCCCACCAGGAACCTGCTTTAGTGGGGGATAGTGAAGAAGAACAATA AAAGATAGTAGTTCAGGCCAGGCGGGGTGCTCACGCCTGTAATCCTAGCACTTTTGGGAGGCA GAGATGGGAGGATACTTGAATCCAGGCATTTGAGAC | SEQ ID NO: 2802 |
| TGFB1 | ADXCRAD_NM_000660_x_at | TTAAGGGAGGAGTTCCTGCCCACCAGGAACCTGCTTTAGTGGGGGATAGTGAAGAAGAACAATA AAAGATAGTAGTTCAGGCCAGGCGGGGTGCTCACGCCTGTAATCCTAGCACTTTTGGGAGGCA GAGATGGGAGGATACTTTGAGACCAGCCTGGGTAACATAGTGAGACCCTA TCTCTACAAAACACTTTTAAAAAATGTACACCTGTGGTCCCA | SEQ ID NO: 2803 |
| TIAM1 | ADXCRAG_U16296_at | TCCAGGAAACTGAACACTGAGATCTGACTGCGTCACCTGCCCCGTAGAGAATGTGTGTAGATA CTTCCTGCCCTAACTCTGCCCACCCTCCTGTACCGTCGACAAGAATGTCCCCTTAGGTCGCGC TCTTGCACACACGGTTTTGGCAGCTGACTTGGTTCTCGAAGCCATGTAGCCACCCAACTTTGTC ATTTTCAACACATCAGAAAGAATTGATCAGAATCCCAAATAAAACCCAAAAGTGTCTAATGT ATTCA | SEQ ID NO: 1062 |
| TIAM1 | ADXCRAD_BM808025_at | ATATCATCTCCGGTTCGATCGCGTCCAGATGGAAAACGGAAGCAGAGGCTTCTAATCGTCGCA TTTACTGGCTCCAGTGCAACACATCCATCTGAAAACACTCGGAAGTCTGTGCTTGGAGAGGG TGCCATTGTCTCTTGTACATAAGGTCATGACGTGTCTATGTCAAAAGTTCTTATATATTTCTT TTATAAGCTGAAAGAAGGTCTATTTTTATGTTTTTAGGTCTATGAATGGAACGTTGTAAATGC TTGTC | SEQ ID NO: 2666 |
| TM6SF1 | ADXCRAD_BG570659_at | AATATTACTTCATGTTCCTCCTTTCTAAATTACTAACTTTTGTTATACTGGTACTGATATTTT GTCCCATTTCACTCTCTTCTCATACGTGAGTACTTAAGAATATGTACATTCTTGCTCTGCACT GTATGTGTGAGCTATATGGTATTGTGTAAATTTTTTTGGAAGGACAATGGAAATTCTTGAGA | SEQ ID NO: 2587 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| | | AACAGTTTGTTTAAACGAAATATATTTCAAACTCATTTGTGAATAAATTGATCATCCATCTCA ATATGTTTGA | |
| TM6SF1 | ADXCRAD_BG285017_at | GAATTTTTTAATATGCACAGGCCATATTCTCTTTTGAATAGTTTCATTTCATGCTCACTACTG TTGGCACTAAATGTAATTTTTTACACTTATAATTATTTTATATGTCAAACAATATTGAGATGG ATGATCAAGTTTATTCACCAAATGATTTGAATATATTTCTTTAAACAAACTGTTTCTCAAGAA TTCCATTTTCCTTCAAAAAAATTTACACAATATCATATAGCTCACACATACAGGCAGAGCCAG AATGTCTATTCTAAGTACCACGTTGTGGA | SEQ ID NO: 2745 |
| TPK1 | ADXCRAD_CD511474_at | TAAAATGGAAGCGGTTGGACTGATGGTGTCTGAGGTTCTTTCCCACACTGAAATTCTAAATAT TGACACTTAGCAGTCATAGGGCTGATAATACACACAGTTACTGACTTAGCCTAAACAACCTGG TGCATCGAAATGTAATCACCCTTTCTTTTGTAAAAGAGACCCATCTTCTATCTTCCTTTCCCA CCTTTTCTCTGTTTTTATGAAAACCCAACTGTTGGACATTCCAAACCATTGGATTTGA | SEQ ID NO: 2381 |
| TPK1 | ADXCRAD_CD511474_s_at | ATTGACACTTAGCAGTCATAGGGCTGATAATACACACAGTTACTGACTTAGCCTAAACAACCT GGTGCATCGAAATGTA | SEQ ID NO: 2382 |
| TPK1 | ADXCRAD_CD511474_x_at | CATCCCAGTCTGATATTCACCTAAGTTTCCGGACCCTTTTCCTTAGCTGTAAAATGGAAGCGG TTGGACTGATGGTGTCTGAGGTTCTTTCCCACACTGAAATTCTAAATATTGACACTTAGCAGT CATAGGGCTGATAATACACACAGTTACTGACTTAGCCTAAACAACCTGGTGCATCGAAATGTA ATCACCCTTTCTTTTGTAAAAGAGACCCATCTTCTATCTTCCTTTCCCACCTTTTCTCTGTTT TTATGAAAACCCAACTGTTGGACATTCCAAACCATTGGATTTG | SEQ ID NO: 2383 |
| TPK1 | ADXCRAD_CR745173_s_at | TGGCCCGCGTGATTGTGGCATTTAAGGAGCAGTGGCCCATGTGACTGTGGCATTTTCGGCACT TTCATTACTTTCTGCTTGACCGGAAGTTGAGGCTTAGCTATGTTTCCATCTTCAGTTTCTGA AGACTTGTTATATATTCCTTACTAGAAATATATTCATAATATATAAAAGAAATATATCTGTGA TTTTAAAATTTTGCTACCAAAGAATGCATGTTCTGTGTGCCCTGAAAATGTTAC | SEQ ID NO: 2592 |
| TRIM14 | ADXCRAG_NM_033219_s_at | TGGACTACGAGGCCGGCGTCCTCGCCTTCTACGACGTGACGGGCGGCATGAGCCACCTGCATA CCTTCCGCGCCACGTTCCAGGAGCCGCTCTACCCGGCCCTGCGGCTCTGGGAGGGGGCCATCA GCATCCCCCGGCTGCCCTAGGGGCCAGGACCGGCGTGACAGCCTCCAGA | SEQ ID NO: 922 |
| TRIM14 | ADXCRPDRC.2569.C2_at | GCAGCAGCAGACTTGTTTAGGGCCTGTTTGAAACTAGCCTAGGAGAGGAAACCTTCAAAGCAC GGTAGGCGTGATGGGTCGGGGAAAGCTGGGGCAGGGAGAGGGCCCTAAGAAGCAGGCAGTAAG GGGACCAGCCACGCTGATCTAGGTAGATTAGGCGAGACTGGGCAGCTGCGGCGACCTGGAGGC TGTCACGCCGGTCCT | SEQ ID NO: 2053 |
| TRIM14 | ADXCRPD.2569.C1_s_at | CATTCCCAAGGGAGCTTGCACGGTACTGACCGAGTGCTGAGACTACTGGTATTCCCAGCTGCC ATGTGGCAGCAGCAGGAGCTACTAGAATATTCTCAGCACAGGAATGAGGCTTCCTTGGTTTCC ATGTCTGTAAGGGTTACTGATCACTTACCTTCTTCTCTT | SEQ ID NO: 2276 |
| TRIM14 | ADXCRAD_BX389413_at | TGGTCTCACTGGGAGTTCATGGTGCTTCAGTCCCTAGCACCCAGTGATACCCCCACAGGTAGC CCTAAGCATCCTGAAACATCATCCGC | SEQ ID NO: 2407 |
| TRIM14 | ADXCRAD_BI222503_at | CACTTAACCCCTCAGCTATGAAAAGGCTTCCAGGAGTTTCCATGACATAACAAAACAACAATA CAAGCGCCTCACCTTAGCATTCAAGGCTTGTCTAGTCTGCCCAACAATTACTTATCCTCACCT AGCTCCTACCAGTCTTCTTAGAGACTCTCCAGTCAGAACATGTGTCGCATAGTTCCACTCCAC ACCTCTCTGCTGACAGCACATTCATGCAGACAAGTCTTTCCACTGTCTCAGACTTCCGCAGGC TTACCTGCGCAGGCAAGTCTAACCAA | SEQ ID NO: 2740 |
| TRIM22 | ADXCRPD.1317.C1_at | GACACCCCATATTCATCACAAAATTAAAGCAAGAAGTCCATAGTAATTTATTTGCTAATAGTG GATTTTAATGCTCAGAGTTTCTGAGGTCAAATTTTATCTTTTCACTTACAAGCTCTATGATC TTAAATAATTTACTTAATGTATTTTGGTGTATTTTCCTCAAATTAATATTGGTGTTCAAGACT ATATCTAATTCCTCTGATCACTTTGAGAAACAAACTTTTATTAAATGTAAGGCACTTTTCTAT GAATTT | SEQ ID NO: 1393 |
| TRIM22 | ADXCRPD.1317.C1_x_at | GACACCCCATATTCATCACAAAATTAAAGCAAGAAGTCCATAGTAATTTATTTGCTAATAGTG GATTTTAATGCTCAGAGTTTCTGAGGTCAAATTTTATCTTTTCACTTACAAGCTCTATGATC TTAAATAATTTACTTAATGTATTTTGGTGTATTTTCCTCAAATTAATATTGGTGTTCAAGACT ATATCTAATTCCTCTGATCACTTTGAGAAACAAACTTTTATTAAATGTAAGGCACTTTTCTAT GAAT | SEQ ID NO: 1394 |
| TRIM22 | ADXCRPD.2309.C1_at | ACAAGTTTCTCTGGGATGTCGCTTTTCTCGACCTGCTTATCCGTATTTCAATCCTTGGAACTG CCTAGTCCCCATGACTGTGTGCCCACCGAGCTCCTGAGTGTTCTCATTCCTTTACCCACTTCT GCATAGTAGCCCTTGTGCTGAGACTCAGATTCTGCACCTGAGTTCATCTCTACTGAGACCATC TCTTCCTTTCTTTTCCCTTCTTTTACTTAGAATGCCTTTGAATTCATTTGCCTAGGGCTTCCA TAGCCAAGCATCATA | SEQ ID NO: 1474 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| TUBA1B | ADXCRIH.69.C1_at | GATCATGTCTTTTCCATGTGTACCTGTAATATTTTTCCATCATATCTCAAAGTAAAGTCATTA<br>ACATCCTCGTGC | SEQ ID NO: 1293 |
| TUBA1B | ADXCRIH.69.C1_x_at | TTTTGGCCCTGCAGCATGTCATGCTCCCAGAATTTCAGCTTCAGCTTAACTGACAGACGTTAA<br>AGCTTTCTGGTTAGATTGTTTTCACTTGGTGATCATGTCTTTTCCATGTGTACCTGTAATATT<br>TTTCCATCATATCTCAAAGTAAAGTCATTAACATCCTCGTGC | SEQ ID NO: 1294 |
| UBE2L6 | ADXCRPD.250.C1_at | TGCCCTTAACCCGATTGGCCATTCCCCTCTCTCCCCCGTACTATACACCCCCGCCCCGCCTT<br>CCTTCCCGCCTTTGTGCGCCTGTCCGATCATANTTTCCGCCCATGGTCCACGTTCTCCGCCGC<br>GTAACCTATATCCTGGATTCTCTTCCCGCCCCGCGTGTGCTACCCCCTTATTGCCATTTTCCC<br>GTTACGCGGAGTTCGCCCGAGGCCCGGGGCTTTGTCGCCGCGTACTTTAGGCCCCGCCCCGCC<br>TAAGTTCCGCCTTCATTATACCGCGCTGTG | SEQ ID NO: 1893 |
| UCK2 | ADXCRPD.10643.C1_at | AAGATTAGATTCCTGCCTCGGGCAGGTGAAAGGAAGGCAGGAAAGAGATTCTGTTTCCTGAC<br>CCAACATTATCACAAAAGACTGTAACAAGGGCTGTGGGAGTTATGGACCAGGAACCTGGTTGA<br>AAACCATTATAAATCATAACACCACAAGGACCTATATTTTGCTTTTTAGGACATTGTAGTAGG<br>TGGGTAGTTTTCATCCTCTTGCTTTTTAAAATCTATCTTGCCCAGAAGTTTATTGGGCATTTC<br>TATGGAAACACAACACCTCTCTTAAAT | SEQ ID NO: 1461 |
| UCK2 | ADXCRPD.9879.C1_s_at | GCAGGCCGCATTGACCCGTCTCCATCGGACCCCAGCCCCTATCTCCAAGAGACAGAGGAGGGG<br>TCAGGAGGCACTGCTCATCTGTACATACTGTTTCCTATGACATTACTGTATTTAAGAAAACAC<br>CATGGAGATGAAATGCCTTTGANNNNNNNNNNNNNNNNNNGTACTTTGGAACGACAAAATGAAAC<br>A | SEQ ID NO: 1541 |
| UCK2 | ADXCRPD.5097.C1_s_at | ACTGGCATTCCAGGTCAGCTTGGCTGTGGTCTTAGAGGCAGGGAGTGCCTACCCAGTCCTGCC<br>TCAGGAGCAGGGTGAGTAGCTAAATACAGACTTAGGCTTTTTTTCCCCCTTTTAAGATGCTT<br>GCTCCTCTCCCTTTTCTTTTTACCACCCTACCTTTATTGTTAGTGGTTACAAAGTGACCACAT<br>ATTATGTACTTTGCTGTAA | SEQ ID NO: 1651 |
| UCK2 | ADXCRPD.14415.C1_s_at | TAGCGGCAAGTCTTCCGTGTGTGCTAAGATCGTGCAGCTCCTGGGGCAGAATGAGGTGGACTA<br>TCGCCAGAAGCAGGTGGTCATCCTGAGCCAGGATAGCTTCTACCGTGTCCTTACCTCGGAGCA<br>GAAGGCCAAAGCCCGGAAGGGCCAGTTCAACTTTGACCACCCGGATGCCTTTGACAATGAACT<br>CATTCTCAAAACAC | SEQ ID NO: 1702 |
| UCK2 | ADXCRPD.15116.C1_at | CCCCTCTGCCAGACAGTGGGTTGAACACACATGTACACCTGAGGAGGAGGGTCTGACGAGGGC<br>TGCCTCAGAGTCAGAGGCAGCAGGACTAGCTCTGTATGTTCGACCTCATGTCTGGCCCATCTT<br>GAGTCCCAGGCTCATACAAAATCACCTGTGTTCAGATACAGATTCAACTCAGTATTTAATGAG<br>CCAAGCACTACTTGAAGCATCTTGACAGTCCTTCTCTTCACATAAGCCCCGACAATCACATCT<br>GCAAGGTACGTATCAAGTCCCTACGTTCCGAGACA | SEQ ID NO: 1715 |
| UCK2 | ADXCRPD.14599.C1_at | TTAAACTCCACCAAGACCCAGCAAGAAGAGCCTCATGGCAGGCTAGGACTGAGTTCTTCCCAG<br>AAGACAGGTCTAAAACACAAGCTTTTCCACCTTAACAATGGATGTCTCCTGACCCCTTCCTCC<br>AGAAATCAAATGGCCAATCTGATGCCCACTTCAGCTTCTGTCATCCCTCTGTAGTCAGACAAG<br>GAGGGCTCGCTCAGCTTGCATTTCCTTCCTGAAGAGTATTCACTACCTCTCTTGTTCAAACAC<br>TATGTATCACTCAAT | SEQ ID NO: 1728 |
| UCK2 | ADXCRPDRC.5097.C1_at | GCAAAGTACATAATATGTGGTCACTTTGTAACCACTAACAATAAAGGTAGGGTGGTAAAAAGA<br>AAAGGGAGAGGAGCAAGCATCTTAAAAGGGGGGAAAAAAAGCCTAAGTCTGTATTTAGCTACT<br>CACCCTGCTCCTGAGGCAGGACTGGGTAGGCACTCCCTGCCTCTAAGACCACAGCCAAGCTGA<br>CCTGGAATGCCAGTCCCCGGTATGAGGAAGGCAGC | SEQ ID NO: 1983 |
| UCK2 | ADXCRPDRC.5097.C1_x_at | GCCTTTTTGTCTGTCTTTATTTACAGCAAAGTACATAATATGTGGTCACTTTGTAACCACTAA<br>CAATAAAGGTAGGGTGGTAAAAAGAAAAGGGAGAGGAGCAAGCATCTTAAAAGGGGGGAAAAA<br>AAGCCTAAGTCTGTATTTAGCTACTCACCCTGCTCCTGAGGCAGGACTGGGTAGGCACTCCCT<br>GCCTCTAAGACCACAGCCAAGCTGACCTGGAATGCCAGTCCCCGGTATGAGGAAGGCAGCAGA<br>ACGCCCAGAGACA | SEQ ID NO: 1984 |
| USP7 | ADXCRAG_AY376241_s_at | CCCCAAAGAGGAGTCGCTACACTTACCTTGAAAAGGCCATTAAAATCCATAACTGATTTCCAA<br>GCTGGTGTGTTCAAGGCGAGGACGGTGTGTGGGTGGCCCCTTAACAGCCTAGAACTTTGGTGC<br>ACGTGCCCTCTAGCCGAAGTCTTCAGCAAGAGGATTCGCTGCTGGTGTTAATTTTATTTTATT<br>GAGGCTGTTCAGTTTGGCTTCTCTGTATCTATTGACTGCCCTTTTTGAG | SEQ ID NO: 908 |
| USP7 | ADXCRPD.11382.C1_at | GAAATACTTGCCTAAGTTTCCCTGATGCTTTCTCCCCAAGCTCCACGGCCTTTTTACATTCTT<br>CTAACAGGTCCCGGACACACCCATGCTTGTCTGGATATAGTGTTATTTCCTAAGTAATGAAAA<br>GATAAAATAAGTGCTTTCAAGAAAGCATAAAAGGTCTGCTACCACAAAGGAAGAGAGGAGAAA<br>GTTGCATCATTGTTCTCAACTGTCCCCAGCTGGCCCCCATGTTCTTGCTCTCATTCCNCACCC<br>CAACTCCCTCATCTGTGAATTCACTC | SEQ ID NO: 1480 |
| USP7 | ADXCRPD.16454.C1_at | GTCTGTCTGGATAAAAGCGTGGCATCACCATAATCTTCCATGGCAGATTTCGCACAAAACACG<br>GAGGGCTAAGGACCGACTCACTCAGTCTGCTGAAGCGCTCCACAGTGAACTGAAAGGCTGCCT<br>CGGAGCGCCAACTGGTGTCATCCTCCATGTCCTCCTCCGCGGTGTTGTGTCCATCACTCAGGG<br>CCACATTCCCATTGATCACAGGGTTCTGAGTAATTCTTGGTGGCTCATCATGTATCTCCCG | SEQ ID NO: 1794 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| USP7 | ADXCRPD.949.C1_s_at | CTGCAAGTGAATTTCACTGATGTTGATATTCATTGTGTGTAGTTTTATTTCGGTCCCAGCCCC GTTTCCTTTTATTTTGGAGCTAATGCCAGCTGCGTGTCTAGTTTTGAGTGCAGTAAAATAGAA TCAGCAAATCACTCTTATTTTTCATCCTTTTCCGGTATTTTTTGGGTTGTTTCTGTGGGAGCA GTGTACACCAACTCTTCCTGTATATTGCCTT | SEQ ID NO: 1919 |
| USP7 | ADXCRPDRC.11382.C1_at | AAGTATTTCTTGAGCCCAATTGTGGACGTTCAGTTAGGGGTGGCAGTTAACGCTGACCTCTGC AGTTGCGTTGGTGGAAATCACCCAGCTGGGATCCATGCGCGTCATTCCCAGACTCAGTGGGGT GTGCCTCCATTGCAAAGACAGTTGCACAGAAGCTCAACACAGACCCATTGTTGCTCCAGTTTT TCAAGTCTCAGGGGTAACCCTCAAGCCGCTGTGGTGCAGAGGGTTATGCGTGTTTCACAATTA AGCCGCGACA | SEQ ID NO: 1940 |
| USP7 | ADXCRPDRC.16454.C1_at | GGGATTTCCAATATTATGGGCATGGAGTAAATGGC | SEQ ID NO: 2022 |
| USP7 | ADXCRPDRC.16454.C1_s_at | GACTGAGTGAGTCGGTCCTTAGCCCTCCGTGTTTTGTGCGAAATCTGCCATGGAAGATTATGG TGATGCCACGCTTTTATCCAGACAGACCACACCAAAAAAGCGTAGGGATTCTTTCTCCAGTGC AATGCTGAATCTGATTCCACGTCATGGTCTTGCGAATGCACAAGCAGTGCTGAAGATAATAAC TTACAGAGATGATGAAAAGTCGTTCAGTCGTCGTATTAGTCATTTGTTCTTCCA | SEQ ID NO: 2023 |
| USP7 | ADXCRSS.Hs#S2990382_at | GATAAATCTTCGTGAAGTGGCAGAAAATATGAAAGCCAGCCAATTGGAATCTTGCTTATTCTG ATCTGTTATCTCAGGGGTTAGATTCGCGTGCTGAAGTGGTCTACGTAACTTCCATAGCGATTG GGAGGTGTTCTCTGGTGGGGTAGCAGTTCTGTGTTATGACATCACACATGGAATTCACGGGGA GGAAAGCTGGGTATAGGCATTAAGTGCCCAGTAGAGCAGGT | SEQ ID NO: 2141 |
| USP7 | ADXCRAD_BU956106_at | CGCTCTTTCCCTTCATTGTGGGGCATTGTTCGGGCCCTTC | SEQ ID NO: 2368 |
| USP7 | ADXCRAD_CA439064_at | GAAGGGCCTCGTGACACATCAGGTCACATCTCCAGTCACCTTATTTGTACACAGTTCTCTCCT GGAAAACCTTTCATTTCTTAAGAGTAAATGTGACTAGTTAGAGGCTAAAAAAAAAAAAAAAAA GAAACAAGAGACCCTGCCCCCGCAAAACGGAATTAGAAGGAAAAGTACATCTCAGTGAAACCT TGTTACAAATGCCAAGGTTTCCCAGGCCTGTTTCCAGGGAGAGTAGAATCTTCCTCCACTTCC ACGTAACTCACTGAATTATA | SEQ ID NO: 2489 |
| USP7 | ADXCRAD_CA437914_at | TGTGTACCTTGGAGTGACTTCCTTTCTCAACTTCCACTGCAGTGTGTGCCTTCTGCTCTGA GAGCTGCCTTGTGACCCGTGTGATAGAAAGCAGGGAGTGAGGGTCCCCGCGGACCTGGCCCTT CCCTCCTTCCTCCCCCAGAAAGAGGAGTTAGAGCAGGGGTGCGAGAGCCGTTCGCTGTGGGTT TGTCTTTGAACAAACATTAAGGTGTCTTGTTTTTGTTCTGGGCTGGGGTTGGCTGTAGTCTT AGGTAACTGAAAGTTCCTACTCTCCCTTAAG | SEQ ID NO: 2597 |
| USP7 | ADXCRAD_AI972599_at | TTGGGAACCAAATGGCTCCAAAAGCCATTTGTCCTCCAAGCGACTACAGGGCAAAGTAGTGAG AATCATGCCCATCTCTCTGAAATAAACAATCAATTCAGGGGCTTCTTTCTACAGCCCAAATGT TGGCTAGATGGAACAGAAGTGACTCAATCTGTCAAATACAAAATCAGGAGTCACCCCTTCCAG TTTCAGTTCATCGTTCAAATGGAATCATATCCTTCCTCTGTTTGGCTTTCTATGGGAACTGC GC | SEQ ID NO: 2811 |
| WDR59 | ADXCRPD.15558.C1_s_at | CAGTGTTACCCTGTAAGGTGTTAGCCTTAAACCACCGAGCAGCGTTCTCTTGATGCCAGTGCA GAGACCAGAGTCAGATGCCCGAGGACAGTGGGTAGGAATTTCATCAACAAATGGACCTATGGC ATCATGGCTTTAGAAGCTGGTACATTTACTGAGCTGATGGACAGTGGCCTTCTAAAATATGAC ACTTAAATTGTAAATATGCACTGTACTTAAGGATTCTTAAGATGTATTTTTTTGTTATTCTC CTCCAGCTGCTATCCCTTGGCTAATAAA | SEQ ID NO: 1764 |
| WDR59 | ADXCRAD_AA393120_at | CCCCTAGAAATCTCCTGGAAGAGAGGAAATCAGATCAACTGGGGCTGCCTCAGACCTTGCAGC AGGAATTCTCCCTGATCAATGTGCAAATCCGGAATGTCAATGTGGAGATGGATGCGGCAGACA GGAGCTGCACAGTGTCTGTGCACTGCAGCAACCATCGTGTCAAGATGCTGGTGAAGTTCCCTG CACAGT | SEQ ID NO: 2596 |
| WHSC1 | ADXCRAG_AF071593_s_at | CCTGTTGAGGTGTGAAATGCCCCGTCAGAAATTAAATACAAACTTAAATGTGCCTATTGGTGT CTAAACTTCATACAATGTAAGGTCAGATTCCTTTTAGGAATACTGGGTGCTGTCACCAGGTTT GATAGTTAGACT | SEQ ID NO: 851 |
| WHSC1 | ADXCRAG_AF071594_s_at | ACTGTGGCTAGTTGTCTGTCCGGTGGCTGGGAGGGGTGTGGTGGGAAAAAGTCGGAATCTCT GCAATCTGTGTCATGGACTGTACTATTGTAAGGTCTATATTCTGTATGTGGGTCCCAGACCCT GATCAGGAAATGAGCCTCATGTGTGTCGTTAACATTTATATATTTCCATTCAAAATATGTATT CAGTGTTTATTTCCTCAAAACAGACTTTGTTAATGTAGGAAATCTCTCCAAGTGGAAACGTGC TAACTTTTTCTGTA | SEQ ID NO: 852 |
| WHSC1 | ADXCRAG_AF083391_at | TTTATTCCTTTAGTAGAGCAAATTCTTATTTTTTCGCCTTCACTGGTAACAGCTTTTGTGGG AGC | SEQ ID NO: 854 |

TABLE 9-continued

Genes and corresponding Almac probesets predicting sensitivity to irinotecan. There can be multiple Almac IDs/probesets associated with a given gene.

| Gene | Almac Probe ID | Probe Sequence | SEQ ID NO |
|---|---|---|---|
| WHSC1 | ADXCRAG_AF083391_s_at | ACCAGTCAAGTTGGATTTGAACCCAGCTGCTCTGTACTGCACTTAGAATGATGTAATATTCCA GGATGCTGCTGCAGGTGGCGTATCATCGTACACACTCAGTGACATTTCTATCACAATCATTTT ATGGAAGATGTGTGATAATCTGTTTTTACTGGTA | SEQ ID NO: 855 |
| WHSC1 | ADXCRPD.10380.C1_at | CCATATGCCAATTAACTTTAACCTAAAAAAATAGAGTGGGAGGGAACCTTGACATTCGGAGAA ATTCNAGTGTGCCGGTAACGCTGAGGAGTGAGGCTGTTTGTCCAGGAACGCTGAGCTGGGCTC AGACGGTCATCAGTGCAGACGCAGCGGACGCTGCTGAGGATGGCTCAGTGGTGGGGAGGCGCT CCCTCCCGAGGAGGCCTGTACGTCTGTGTCCTGGCGGCTCGAGCTGGGTCCTCCGGGCCAGTT CATGCTCG | SEQ ID NO: 1396 |
| WHSC1 | ADXCRPD.1426.C1_at | GCGTCTCGTCAGATATCTCTACTGAAATGTGGTGCGTGTCGCGGGNCGAGNAGACACTCTTC TTTCGACTNACTCTACCTGTGACTATATATGTGTGNNCTCGTTCCGCCTNACTACGCATTTAG CACACTATCCCTCGTTAGTCTCTCGTCTCCCCATAATACGAGTACCACGCGCTCGTCTGTCAT ATCAGATAGGATACATAGTCTGGGGCCTCTCGTATGATTCATTTCGCTCGCCCGCCACGAGTA ACAATCTTGCGTTCCCACCCTCCTTCGTCCCTCTGTCGTTGGAAGGCC | SEQ ID NO: 1416 |
| WHSC1 | ADXCRPDRC.10380.C1_s_at | TCCCAAGGGTCGCTAGAAACTCGTCTTCGCGTTGCCCCCTTTCTGGCTCTCAGCGCCGTCGCC ACTCGGGAGAGGCTGGGTGAGGCCCGTGTGAGGACTGACCCTGGATTCCTCGAAACTGCCATT GTGATCATTACTCTGCTCTTTGGAAATGGCTG | SEQ ID NO: 1922 |
| WHSC1 | ADXCRAD_BM712589_s_at | GTCAGAAGTTGATAGGTTGTTAAATACATTTATATAATACATTAAATATGTGAAATTAATACA CCTTCCTACATTTTGAAGGTGATGCATAGATCCCATAGTGTGCATCATGTTCCTTATATGAAA ACGTTTAAATTACTGGGTCTTTTCCATTAAACTACTTTTGTATGGCTTAGATAAATCTTCCAT TAGTGTTCATTTTTATAGAATTATGCTGTTAAAACTACTTTAGGTGAACAAATAAACTTGTCT ATTATATATTAACGCGACTGAACTACAG | SEQ ID NO: 2351 |
| WHSC1 | ADXCRAD_BM755805_s_at | CAGGTGTCCGCATTTTTGCATGGTAAGGAAAAGGCTTACTTGCCCTTCAGCTCATAAAAGCAG AAGGTGTGCTATTCACAGTACCATGCGAGTAGCCCACAGTTAATTCCCGGCAGATTCTTTGGC TGTGTTTTATCTTTAATGAACGTTTCTGACTAATATTTTGTTGTAAACCATTAAGTAATGTAA CGCATGTAAGATGCTTAGGGTGCCTGGCCAGGACTCCGTGGTTTCCTGTTGTGACAGTAATAA T | SEQ ID NO: 2352 |
| WHSC1 | ADXCRAD_CN390223_s_at | TGGTGCTGTGTGACCGCAAGTTCTGCACCAAGGCCTACCACCTGTCCTGCCTGGGCCTTGGCA AGCGGCCCTTCGGGAAGTGGGAATGTCCTTGGCATCATTGTGACGTGTGTGGCAAACCTTCGA CTTCATTTTGCCACCTCTGCCCCAATTCGTTCTGTAAGGAGCACCAGGACGGGACAGCCTTCA GCTGCACCCCGGACGGGCGGTCCTACTGCTGTGAGCATGACTTAGGGGCGGCATCGGTCAGAA GCACCAA | SEQ ID NO: 2483 |
| WHSC1 | ADXCRAD_CN390208_s_at | CCCGTAGTTTTTTCTCCTCATGGATTTGAATGAAATGCCAATAACACGTCCACTTTCAACGTG TAGTTTACGCGGAGCACTTTCGAGGCCTGGCCGGGTTGGGCCTACTTCTCACCTGGGCCTATC TTCTGAACTCGCTAGGTTCTTATCAACATT | SEQ ID NO: 2484 |
| WHSC1 | ADXCRAD_BF970701_at | GTGTTGGACACTGTGTATGAGTATTTTGTTTCAAAACTTTAACGCCTTTTCTTACGTTAAAAA CAAAAAGGGGGCGCTAAAGTTCTCCCGAGCGCCCAGTAGCGGTACCCGCTTTCCGTCCACAG GGGCCCCATGAGAGCCGGAAATAAGCAAAGACAGGCGAGTTTAACAGCGGCGCGGGAACCCGC GCCGTCGGGACCTGGGAGGAACCACTCCGGGGGACATGGACACCCAGAAGAAGCCGGAAAAAA AGGGAGCTAAACGCACTCGCGAGTGCTGTAAAACACACAAG | SEQ ID NO: 2485 |
| ZAP70 | ADXCRAG_BC053878_at | ACACCGGCCTTGCATTGCCTGCCTGGCCCCCTGTCCTCTCTGGCTGGGGAGCAGGGAGGTCCG GGAGGGTGCGGCTGTGCAGCCTGTCCTGGGCTGGTGGCTCCCGGAGGGCCCTGAGCTGAGGGC ATTGCTTACACGGATGCCTTCCCCTGGGCCCTGACATTGGAGCCTGGGCATCCTCAGGTGGTC AGGCGTAGATCACCAGAATAAACCCAGCTTCC | SEQ ID NO: 973 |
| ZAP70 | ADXCRAG_BC053878_x_at | GAGGGTGCGGCTGTGCAGCCTGTCCTGGGCTGGTGGCTCCCGGAGGGCCCTGAGCTGAGGGCA TTGCTTACACGGATGCCTTCCCCTGGGCCCTGACATTGGAGCCTGGGCATCCTCAGGTGGTCA GGCGTAGATCACCAGAATAAACCCAGCTTCC | SEQ ID NO: 974 |
| ZAP70 | ADXCRAD_AW950959_at | TGAGCCCTGCTTGGGTTGTTCCACACACAGTTGGCCTGT | SEQ ID NO: 2321 |
| ZAP70 | ADXCRAD_AW950959_s_at | GCACTCATGAGTGACTGCTGGATCTACAAGTGGGAGGATCGCCCCGACTTCCTGACCGTGGAG CAGCGCATGCGAGCCTGTTACTACAGCCTGGCCAGCA | SEQ ID NO: 2322 |

TABLE 10

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| ACTN1 | ADXCRAG_BC011987_s_at | GGAAAGATTAACTATTTGCACCGAAATGTCTTGTTTTGTTGCGACATAGGAAAATAACCAAGC ACAAAGTTATATTCCATCCTTTTTACTGATTTTTTTTTCTTCTATCTGTTCCATCTGCTGTAT TCATTTCTCCAATCTCATGTCCATTTTGGTGTGGGAGTCGGGGTAGGGGGTACTCTTGTCAAA AGGCACATTGGTGCATGTGTGTTTGCTAGCTCACTTGTCCATGAAAATATTT | SEQ ID NO: 934 |
| ACTN1 | ADXCRSS.Hs#S3748482_at | GGCACAGAGGAAACCCGCTGAGCCTGCTTCCTTAGTTCTGGCAGATGGGTCAGCCCCCACAGG ACTCAGGATTCAATTTAGCCCGGGGTTCTGGCTCCATCTCCCACAGTGCCGGTGCCAGTGTGC TCCTAAGTACTGTTTGTGCAAACCTGGCTCTGACTGAGACAAGGAGCCTTAGGAGTAGTAGGG ACAGGAGACACAGCAAACTAGGGCTCAGA | SEQ ID NO: 2203 |
| ACTN1 | ADXCRAD_CX871590_s_at | TCTCCTGCCTGGGTTCGGTTTCAGCTCCCAGCCTCCACCCGGGTGAGCTGGGGCCCACGTGGC ATCGATCCTCCCTGCCCGCGAAGTGACAGTTTACAAAATT | SEQ ID NO: 2469 |
| ACTN1 | ADXCRAD_BM714793_at | AAGAGAATTTATGTGGCTTCTCATTTTTAAATCCCCTCAGAGGTGTGACTAGTCTCTTTATCA GCACACACTTAAAAAATTTTTAATATTGTCTATTAAAAATAGGACAAACTTGGAGAGTATGGA CAACTTTGATATTGCTTGGCACAGATGGTATTAAAAAA | SEQ ID NO: 2737 |
| ACTN1 | ADXCRAD_M95178_at | GACGTCAGCCTGTACAGGCTCCCAGGGGTGGCGTCAAATGCTATTGAAATTGCGCTGAATCGT ATGCTTTTTCC | SEQ ID NO: 2816 |
| ACTN1 | ADXCRAD_M95178_x_at | GTGCGCCGTGCCCACAGATGTGAAATGAATGTAATCTAATAGAAGCCTAATCAGCCCACCATG TTCTCCACTGAAAAATCCTCTTTCTTTGGGGTTTTTCTTTCTTTCTTTTTTGATTTTGCACTG GACGGTGACGTCAGCCTGTACAGGCTCCCAGGGGTGGCGTCAAATGCTATTGAAATTGCGCTG AATCGTATGCTTTTTCCTTTTGA | SEQ ID NO: 2817 |
| ASAH1 | ADXCRAG_U70063_at | TAAACAGTCACTGGAAAGAGTGCCAGTCAGCAGTCATGCACGCTGATAAAAAA | SEQ ID NO: 1074 |
| ASAH1 | ADXCRAG_U70063_s_at | TCTTCAGATTGATAGGGAGTTTTAAAGAAATTTTAGTAGTTACTAAAATTATGTTACTGTATT TTTCAGAAATCAAACTGCTTATGAAAAGTACTAATAGAACTTGTTAACCTTTCTAACCTTCAC GATTAACTGTGAAATGTACGTCATTTGTGCAAGACCGTTTGTCCACTTCATTTTGTATAATCA CAGTTGTGTTCCTGACACTCAATAAACAGT | SEQ ID NO: 1075 |
| ASAH1 | ADXCRSS.Hs#S1748600_at | TTTTCCTTATTTTCAGACTACTGTACTGCCTATTAAAGTTGATTTCAGACATGCAAAAAAACC TGGAAGAAATGTTGCAGGGCTAGAAACATTCTTCTCTTCCTCATAGTTTACTTCTACCCATCT ACATGATTTGATAGAAGTGCTCGCAGGAGGTGCTTCCTTAACTTCGGTGTATGTCATGACATC TGTCCTTTTCTTGAGGGCAGAACAC | SEQ ID NO: 2086 |
| ASAH1 | ADXCRAD_BQ186493_s_at | GATCAAGATACGGAAGAGCCCAGCACTCCACGATGCTCCATCATGCCCCTTTGCAGAAAATAC TGCCTCCTCCAGTAAACACTATTCTGATGTCACTATAGATAAGTTTTGCCTCTTCGTGAACTT TGTATAAATAGAACTGAACAATATGAACTGTCCTGTGTGATTCTTGTATTTCATTATGGGTG GTGTGCTATTGTATCAACAGGGTAT | SEQ ID NO: 2730 |
| C19orf21 | ADXCRIH.3146.C1_at | AGGGTGGCACAGATCGCAGCACCTTGAGGGGCTGCGGGTCTGAGGGAGGAGACACTCAGCTCC TCCCTCTGAGAAGTCTCAAGCTGAGAGGAGAGACCTGCCCCTTTCCAACCCTGGGAAACCATC CAGTCTGAGGGAGGAGGCCAAACTCCCAGTGCTGGGGTCCCTGTGCAGCCCTCAAACCCTTC ACCTTGGTGCACCCAGCCACACCTGGTGGACACAAAGCTCTCACATCGATAGGATCCCATGAG GATGGTCCCCTTCCCTGCGAGAAA | SEQ ID NO: 1204 |
| CCND1 | ADXCRPD.3501.C1_s_at | TCTGTCTGAACCACGCGGGGCCTTGAGGGACGCTTTGTCTGTCGTGATGGGCAAGGGCACA AGTCCTGGATGTTGTGTGTATCGAGAGGCCAAAGGCTGGTGGCAAGTGCACGGGGCACAGCGG AGTCTGTCCTGTGACGCGCAAGTCTGAGGGTCTGGGCGGCG | SEQ ID NO: 1592 |
| CCND1 | ADXCRAD_BM551840_x_at | TGAGGGACGCTTTGTCTGTCGTGATGGGCAAGGGCACAAGTCCTGGATGTTGTGTGTATCGA GAGGCCAAAGGCTGGTGGCAAGTGCACGGNGCACAGCGGAGTCGTCCTGTGACGCGCAAGTC TGAGGGTCTGGGCGGCGGCGGCTGGGTCTGTGCATTTCTGGTTGCACCGCGGCGCTTCCCAG CACCAACATGTAACCGGCATG | SEQ ID NO: 1593 |
| CCND1 | ADXCRPD.3980.C1_s_at | GGAGGTGGACCTGGCTTGCACACCCACCGACGTGCGGGACGTGGACATCTGAGGGCGCCAGGC AGGCGGGCGCCACCGCCACCCGCAGCGAGGGCGGAGCCGGCCCAGGTGCTCCCCTGACAGTC CCTCCTCTCCGGAGCATTTTGATACCAGAAGGGAAAGCTTCATTCTCCTTGTTGTTGGTTGTT TTTTCCTTTGCTCTTTCCCCCTTCCATCTCTGACTTAAGCAAAAGA | SEQ ID NO: 1679 |
| CCND1 | ADXCRPD.13939.C1_at | TTCACATTGTTTGCTGCTATGTGGAGGATCAGTGTTTTGTGTTACAATGTCATATACTGCCAT GTACTAGTTTTAGTTTTCTCTTAGAACATTGTATTACAGATGCCNNNNNNNNNNNNNNNNNN NNNNNATGTGATCAATTTTGACTTAATGTGATTACTGCTCTATTCCAAAAAGGTTGCTGTTTC ACAATACCTCATGCTTC | SEQ ID NO: 1727 |
| CCND1 | ADXCRPD.16054.C1_at | ACCAAGTAGCTGTGGGTTGAACCTGGACGTGAGCTGGTTGCAGGGCCGTTGGGTAGAAAACCA GCATCTCATAAACAGGTCACTACAAAAATAGGAAGAGTATAAAAATAGAATATATTATGTCAC TATTTCGTCTTCTCTTTATAGTAGCGTATCGTAGGAGTGGGACAAGGTGGCCTTTCCCGACAC | SEQ ID NO: 1752 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|------|----------------|----------------|-----------|
| | | TGCTACGCTGGTCTGTGCCCGACAAACCTCACCTGATGTTGTACCTGAGTACGTTACTAAATCCTCAAGACCTTACACACAGC | |
| CCND1 | ADXCRPD.15960.C1_at | TGCCCGACAAACCTCCACTGGATGGTTTGTCACTGGATGGTTTGTTGGGGTGGTGGTCACAGGCGCAAAGGACATGCACACGGCCACGCTACGCTACTGTAACCAAG | SEQ ID NO: 1817 |
| CCND1 | ADXCRPDRC.16054.C1_at | GTAGTGACCTGTTTATGAGATGCTGGTTTTCTACCCAACGGCCCTGCAACCAGCTCACGTCCAGGTTCAACCCACAGCTACTTGGTTTGTGTTCTTCTTCATATTCTAAAACCATTCCATTTCCAAGCACTTTCAGTCCAATAGGTGTAGGAAATAGCGCTGTTTTTGTTGTGTGTGCAGGGAGGGCAGTTTTCTAATGGAATGGTTTGGGAATATCCATGTACTTGTTTGCAAGCAGGACTTTGAGGCAAGTG | SEQ ID NO: 2013 |
| CCND1 | ADXCRAD_BQ436873_at | AAAAATAGTATTTGCATAACCCTGAACGGTGGGGAAGAGGGGTGTGCTACANATGATAGAGGGATTTTATACCCCAATTATCAACTCCGTTTTTATATTAATG | SEQ ID NO: 2640 |
| CPNE3 | ADXCRAG_AF077226_at | CAAGCTATAGTTAATGCCTCCAGGCTGCCTATGTCCATCATAATTGTTGGAGTTGGAGGTGCTGACTTCAGCGCCATGGAGTTTCTGGATGGTGATGGTGGAAGTCTTCCGCTCCCATTGGGCGAAGTGGCCATCAGAGATATTGTCCAGTTTGTGCCTTTCAGACAGTTCCAGAATGCTCCAAAAGAAGCACTTGCTCAGTGTGTCTTGGCAGAGATTCCCCAGCAGGTGGTGGGCTACTTCAATACATACAAACTCCTTCCTCCCAAGAACCCAGCCACGAAACAACAGAAG | SEQ ID NO: 853 |
| CPNE3 | ADXCRIH.2935.C1_s_at | AGAAAAATTTGAAGTCTGATCAGAGATTTACAACTGTTCATTATAGTGGTGCCTTAGGCAATCTTTCCAAAGTAAATTCAGGGCCCCATTGCTACTTATGCCATATTTGGACATACNNNNNNNNNNNCTTCAATTTTGTAAACTTCCTGGAAAGCTG | SEQ ID NO: 1227 |
| CPNE3 | ADXCRAD_BP222406_at | TGAAATTCAGAATTCCGTTTCCTTCTAACTAATGAAAAACTGCTTACTAAAAAAAATTTTATACTTTCCTTGCTAAGGTCCCATATATTGATTTGTACAGATCCACTTAGTCATTTTCTCCTTTT | SEQ ID NO: 2387 |
| CPNE3 | ADXCRAD_BP222406_x_at | TGAAATTCAGAATTCCGTTTCCTTCTAACTAATGAAAAACTGCTTACTAAAAAAAATTTTATACTTTCCTTGCTAAGGTCCCATATATTGATTTGTACAGATCCACTTAGTCATTTTCTCCTTTTTTTAAGAACCATTTTCATCTGATTTTTAAACTCACGATACCAGTTATCTGTTAATCAAAATTGCATTTTACAATTTAATAATGTGATATTTCCTATGTCTACAGCAT | SEQ ID NO: 2388 |
| CPNE3 | ADXCRAD_CB153171_s_at | AAGCTGTCTTCACTAAGTATCCCCTAGTCTCTATATATGTGGTTAGTAGTCATGGAAATGACACATAAAGTACGCCAGAAGTTTGATGGAACGTGTTAGAAACTGTTTTGTGCTTTTATGGATGTCATACTTGACAATACATGTGTAAGTTACTAATATATGAATTGATGCTAAATATATCTTACATTTGA | SEQ ID NO: 2615 |
| CTBP2 | ADXCRAG_AL833398_s_at | GTTACATGTTCTATTCATAGTCTTTTGTGAATCATTGCCTTTTTGTTTAAAAAGATGGCCTATTTTGAGCCTTTGTATAGGTACATTCCTGTTTTTGTGACAAAAGAAAAACTTTAAAATTGTCCCAAACAGAAAAATAATGGCTATCAGAGATATGTTTTGTTTTAGTGTGAGTTACCGTTACTGTATTTGTTTATTGTAAAGGTGGACATTTAGCGTTCAGTCAGTTTTCAATAA | SEQ ID NO: 899 |
| CTBP2 | ADXCRIH.1931.C1_at | GTGACTTGAGTTCCCTTAAGTCCTCTGGGGCTGGTGACCTC | SEQ ID NO: 1216 |
| CTBP2 | ADXCRIH.1931.C1_s_at | ACGGAAGCGCTGAAAGACTAGGATGTGATTTATTAACGACCAACTTCTGTTATTGTGTGTTAAGTTTTTCATCTGTGCATCAAATCACAAAAAGAATAAATAGAGCTTTTTCTTTATCAGTCCCTTGGGCACAGAAGGTCCTGAACACCCTGCTCTACAATGTTGCATCAGAGTTCAAACAACAAATAAAAAATATTAAGAGGGAAATCCCCATCCTGTGACTTGAGTTCCCTTAAGTCCTCTGGGGCTGGTGACCTCTTTTTGCTAATAG | SEQ ID NO: 1217 |
| CTBP2 | ADXCRSS.Hs#S3008063_at | TCACCCAAGGGACCACACTGGGAAACCCAGTAGTTGTCTCGGCCATGGCACTAAGACCTTTGCACCCTGGCCATCTTGTTCCGGGACAGCCAGCATCTGTGGTGTGGTATAGAGACAAAGCTGCCACCTCCAGGACACTTGCTCCTTCCTGGCCTTCCTGCTGCCCTGAAACCTGTGGCCTGTGTGTTAGTGGAAACATTCTCAGTTTCATTGCTCAGTAAACCTTAGGTTATCCAAACTGCAAATAAATGTTCTCTACTTTCTAGATTTTTATAACTTGCTATTTTGAG | SEQ ID NO: 2168 |
| CTBP2 | ADXCRAD_BG614034_at | TTCTGACTTTAATCTACCCCAAAGCAAAATGACCTGGACCTGGTTCAAGGGAGGGAAGTGAACCTTGAAACTGTTTTGGCCAATAACCTTAACAAACAAAATGATATTTACCAAAAGAAGTGTTGCAAATAGTCTCATGAGTTAAGAGCTTGATTTAATGGATCTTCTTTTT | SEQ ID NO: 2365 |
| CTBP2 | ADXCRAD_BG614034_x_at | TTCTGACTTTAATCTACCCCAAAGCAAAATGACCTGGACCTGGTTCAAGGGAGGGAAGTGAACCTTGAAACTGTTTTGGCCAATAACCTTAACAAACAAAATGATATTTACCAAAAGAAGTGTTGCAAATAGTCTCATGAGTTAAGAGCTTGATTTAATGGATCTTCTTTTT | SEQ ID NO: 2366 |
| CTBP2 | ADXCRAD_CX866865_s_at | GACTTGAGTCCCTTAAGTCTACAGGGGCTGGTGACCTCTTTTTGCTAATAGGAAATCACATTACTACAAAATGGGGAGAAAACTGTTTGCCTGTGGTAGACACCTGCACGCATAGGATTGAAGACAGTACAGGCTGCTGTACAGAGAAGCGCCTCTCACATCTGAACTGCATACTGAGCGGCAAGTCGGTTGTAAGTTCAGTAAA | SEQ ID NO: 2503 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| CTBP2 | ADXCRAD_AK024129_x_at | ACTTAAGAAGTAATGTCCCTTGGCTGGGCGCGGTGGCTCATGCTTGTAATCCCAGCACTTTGG GAGCTGGAGGTGGGCGAATCACCTGAGGTCAGGAGTTCAAGACCAGCCTGGGCAACATGGCGA AACCCCGTCTCTACTAAAAATACAAAAATTAACCGGGCATGGTGGCAGGCTATAATCCCAGGT ACTCGGGAGGCTGAGGCGGGAGACTCGCTTGAACCCAGGAGTTGGAAGTTGCAGGGAGCTG | SEQ ID NO: 2829 |
| DSG2 | ADXCRIH.2137.C1_at | AGAGTACCTAGTTCATCAGCCGTCCAGTAAAGCAACCCAAGGAAACTGACTGGGTCTCTTTGC CTACCGTATTAACATTAAACATTGATGTTTCTGTATTCTGTACTTTACTGCACCCCAGCAGAC TTTCAACAACTCATT | SEQ ID NO: 1191 |
| DSG2 | ADXCRPD.13409.C1_at | TTTCATCGTGGCTTCCTTGGCCATACCTCCTACTCCATTTCGTCCTACTAGACTGCCCCCTTG ATCCACTGGCAGAAATGATGGCACCACCTTGTCTTCAGGTGGTGCTCCTTCATTATTCCAAGG ATGCAGCATCTCTATGGTGCCAGGTATGGGGGTAAAGCCTTTGGCGCCCTTTCCGCAATGGCA CATCAGCAGTAAAAGTGGTACCAATAGCAGGAGCAGAAAGGCCAAAATCATGAGCGCAATTGC TGCGGGTCCCAGGCCCACATAGGAGTCATG | SEQ ID NO: 1640 |
| DSG2 | ADXCRPD.13497.C1_at | AGTCAATGTAGAAGTTACGCGCATAAAAGTGTTCGATGCAGATGAAATAGGTTCTGATAATGG GCTGGCAAATTTTACATTTGCATCAGGAAATGAAGGAGGTTATTTCCACATAGAAACAGATGC TCAAACTAACGAAGGAATTGTGACCCTTATTAAGGAAGTAGATTATGAAGAAATGAAGAATCT TGACTTCAGTGTTATAGTCGCTAATAAAGCAGCTTTTCACAAGTCGATTAGGAGTAATACCAG CTACACCCATTCCATCATGTCAAGTGAACATGTGACGAGGCTCATTTA | SEQ ID NO: 1653 |
| DSG2 | ADXCRAD_BQ887548_s_at | TTTCATGTTTCCAATGTACCTGATTTTTCATGAGCCTTACAGACACACAGAGACACATACACA TTGATCTTAAAATTTTTCTCAGTCACTGATATGCAAAGGACCACACTGTCTCTGCTTCCAGGA GTATTTTTAGAAATGTTCCACAATTTACTGAAGACATANAGATGATGCTGCTGCTTANGTGCC TTTTAGCAAGCTATGCAAACAATCCTGATAAAANCAGATACTTAGAGAGTCAATCTGGCTTCT GAGAA | SEQ ID NO: 2313 |
| DSG2 | ADXCRAD_BE171045_s_at | GAGGAGTAGGTATTCTCTGAATTAACCATAGATTTGCTCACAGAGCTGAATGTGAAGCTGTGT TCATACTTGTTTCTGTGGCAGGTTTTTGTCTCTGCTCAATTTCCTTATTTATATCTATTTTTT GACCCAGGCAAACTTCAGCTAG | SEQ ID NO: 2324 |
| GPX4 | ADXCRIH.2240.C1_at | ACCAAGTTCCTCATCGACAAGAACGGCTGCGTGGTGAAGCGCTACGGACCCATGGAGGAGCCC CTGGTGATAGAGAAGGACCTGCCCCACTATTTCTAGCTCCACAAGTGTGTGGCCCCGCCCGAG CCCCTGCCCACGCCCTTGGAGCCTTCCACCGGCACTCATGACGGCCTGCCTGCAAACCTGCTG GTGGGGCAGACCCGAAAATCCAGCGTGCACCCCGCCGGAGGAAGGTCCCATGGCCTGCTGGGC TTGGCTCGGCGCCCCACCCCTGGCTACCTTGTGGGAATAAACAGA | SEQ ID NO: 1246 |
| INPP4B | ADXCRAG_BC005274_at | CTTACTCACTGTGATCAAATGGTGAATATGTACCAAGACATTCTGACAGAACTTAGCAAGGAA ACAGGGTCCTCTTTCAAATCAAGCAGCAGCAAAGGAGAGAAAACATTAGAATTTGTTCCAATA AATCTACATCTGCAAAGAATGCAGGTACACAGCCCTCACTTGAAAGATGCTCTCTACGATGTC ATCACTGTGGGAGCCCCAGCTGCCCATTTTCAGGGATTTAAGAATGGTGGTCTTCGGAAGCTA CTCCATAGATTTGAAAC | SEQ ID NO: 919 |
| INPP4B | ADXCRPD.8849.C1_at | GATGATCACAGATGTTTCCCAAAATCTAGGAACTACTTCAATTCATCATCAGCATATGGCTCT GAAAGAAATCCATTTTAAAAAATCTTACATGATTCAGTACTGTCATTTCTAGTTCTAAGCTTC TATGTGTTGAGCCTAGCTGATTGAGATGGGTTCACAAAGGGTAAATTTCATTCATGAGTATTT AAATGTTTCTGAGGAAACATGGATCATTTCAATAGGACTAG | SEQ ID NO: 1453 |
| INPP4B | ADXCRPD.12698.C1_at | CTCAGACCCTGCCAAATACCATTCTAATTCTGTTCTGTTTCTATGAGTTTGACTTTTTTAGAT TCCGCATGTGAGAACATAAAGTATTTGTCTTTCTCTGTCTGACTTAGCATAATGCCCTCAAGG TTCATCCATTTTGTTGCAAATGACAGAATTTCTTACTTTTCT | SEQ ID NO: 1616 |
| INPP4B | ADXCRPD.12698.C1_x_at | TAAAGTCTGTACCTTTGATCATCATCTTCCCATTTCCTCCTCCCCTCAGACCCTGCCAAATAC CATTCTAATTCTGTTCTGTTTCTATGAGTTTGACTTTTTTAGATTCCGCATGTGAGAACATAA AGTATTTGTCTTTCTCTGTCTGACTTAGCATAATGCCCTCAAGGTTCATCCATTTTGTTGCAA ATGACAGAATTTCTTACTTTTCTTTGCCTGAAATAAT | SEQ ID NO: 1617 |
| INPP4B | ADXCRSS.Hs#S3748650_at | AATTCTAAGCAATGATATGTGGACTAATTCGATGATCTACATGGAGGTTTACTGCCTTTGAAA GAAGCAGTGATGACTCGAAGCCTATGTGGCCTCATTAGTGAAAATAATTTCAGAGGAACTTTA TCTTTGACAGGATTTACAGCTGGATAGATTAGGAAAAAATAATTCAATGGCATAGGATATTTGG CCTTTTACAGGGCATTTCATGACATACTTGTGAAAGATGGAGAAATATAGGCCATGCAATGAT ATG | SEQ ID NO: 2199 |
| INPP4B | ADXCRAD_CB852249_at | GGTGCCATATTGCTTTGTATAAGTTATTTTCCATCAAGGATTTGTGTCTGCTTTGTGTGCTGC TATATAATAATTATGTCTTGCTGAAGTTCTTCTGCTTATTGAATTCCTCTACTGAAGTTCCTT ACTTATTCAAATAAGTAAGGTAGGAGGTACTTAGTCAATTGAGCAGCTAATTGGCTAAAAGTG TCTTGAGCACAAGATAAGCATGTACTGAAAAACTGAGTATCTCTTGTCCATTGTTA | SEQ ID NO: 2386 |
| INPP4B | ADXCRAD_BG199926_s_at | CACTTGAACAATGCTCAATCTTGAGAGATGAGCACCAGTTACACAAGGACTTCTTTATCCGAG CGCTGGATTGCATGAGAAGAGAAGGATGCCGCATAGAGAATGTACTGAAGAATATCAAATGCA GAAAGTATGCTTTCAACATGCTACAGCTGATGGCTTCCCCAAGTACTACAGACCTCCAGAGG GGACTTATGGAAAAGCTGACACCTAAGTTTACCAACATGTTA | SEQ ID NO: 2625 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| INPP4B | ADXCRAD_BG199926_x_at | ACATCGATGTCAGTGACACTTGAACAATGCTCAATCTTGAGAGATGAGCACCAGTTACACAAG GACTTCTTTATCCGAGCGCTGGATTGCATGAGAAGAGAAGGATGCCGCATAGAGAATGTACTG AAGAATATCAAATGCAGAAAGTATGCTTTCAACATGCTACAGCTGATGGCTTTCCCCAAGTAC TACAGACCTCCAGAGGG | SEQ ID NO: 2626 |
| JUP | ADXCRAG_AF233882_x_at | ACAGAGCAAGAACCCGTGTCTTAAAAGAAAAGAAAAACAGGAGGCTGGGTGCAGTGGCTCACA TCTGTAGTTCCAGCACTTTGGGAGGTGCAGGCAGAGGCGGAAGCGGAAGGATCACTTGAGGCC AGGAGTTTGAGACCATCATGGGTAACATAGTGAGACACCCATCTCTTACAAAAAATT | SEQ ID NO: 873 |
| JUP | ADXCRIH.2082.C1_s_at | AGCTGCCCTAGCTGACCCCGAGAAGTGCTCTTGGCTGACCCCTCTGGTGTGTGGTGAGGGGCT TTCTCTTCCCCTTCCTGTTTCAGACCCCCCCATTTCCCGCACATGGTGTGGGGGGCTGGGGGA GGTCCAAGCAGAGTGTTTTATTATTATCGCTTTATGT | SEQ ID NO: 1152 |
| KDELR3 | ADXCRIH.3560.C1_at | GTATGTGACCAAAGTCCTTAAGGGAAAGAAGTTAAGTCTTCCAATGCCAATCTGAGGACCTTC AGAGACAGTCTACGCCTTAACAAGCACATGAAGGAAACTATTTTGAATGTTCTCTTTGGCAAC TTATCCATAATTTGGGATCAAATGTTAAAACCAGAAAAGTGTTTAGTGTGGATTTCAGCA AACCTG | SEQ ID NO: 1221 |
| KDELR3 | ADXCRPD.11126.C1_at | AGAGGAGGGACATTGTTCCAGATTGGGGTTGACTTGCCCATCATGAGTCTTGCCCTCAGGCCT TGGAGAACAATCATTTATGTTTTTTATTTCGTCGGTAAGACACCTTAAGGTTTCTTGTTGCAG TGAGGCACCATCTTTGTGCAGTTGGCCGAGGTTTTTTATGACCTTACAATGGGTCTTTAAGGG CGATCTATTGATGA | SEQ ID NO: 1428 |
| KDELR3 | ADXCRPD.3569.C1_at | TACTTAGGCGAGTACCATTTGCACAATCACTGTTTTACTTATGAGCAGATACAGATATATCCA AACCCTTACCTACTAGGTATCCTGCTAGGGTTTTCAATTCCAATTCTTGTATTAAGTTTTTTC CTTTCAGTTTTAGGTGCGAAAGTAATCAGTCAATCCAATATCCCCCATCTTTGTCTTGAAACA AAAACTGTTTTAAGACGTCTACGTTGAATTATTCAGAGAATTAAGCAATAAAAGCTCACACCT TAT | SEQ ID NO: 1599 |
| KDELR3 | ADXCRPDRC.11126.C1_at | GACCTTTTCATCAATAGATCGCCCTTAAAGACCCATTGTAAGGTCATAAAAAACCTCGGCCAA CTGCACAAAGATGGTGCCTCACTGCAACAAGAAACCTTAAGGTGTCTTACCGACGAAATAAAA AACATAAATGATTGTTCTCCAAGGCCTGAGGGCAAGACTCATGATGGGCAAGTCAACCCCAAT CTGGAACAATGTCCCTCCTCTTAG | SEQ ID NO: 1932 |
| KDELR3 | ADXCRSS.Hs#S3732256_at | GGCTTAACCAGCTAGACATTCCTCTAAATACATACGTAACAAAAATTGATGGCAGGAGATTTT ATTGGGATCACTGGATACCTACACTCAACAGGCAGAACTTGGCTAATTCCATTTATACCACTA CTGAGACAGTGAAGACAAATTAAGAATCAGAACAGGAAGCACATAGCCATAGGGATACCCGTGT CAGCGACATATTTAATATGCCCCTCAGCTTAAGACTCAATACTGAACAGACCAAAAGGCCACC TCAATTGCCGCTCCCGCCACACTTGCTATTGAAACT | SEQ ID NO: 2149 |
| KRT18 | ADXCRIH.1401.C1_s_at | CACCAAAGTTCTGAGGCATTAAGCCAGCAGAA | SEQ ID NO: 1151 |
| LAD1 | ADXCRAG_NM_005558_at | TCTTCTCACATTAAGGTGGTGGCTTGCCACTCAGCAGTCCTAGCTTGGTGACTGGGAACTGCC ACATACAGGGCCAGGCCTACCCTCCTTCCCCACAAGCCCCCTCCAACCCCCACCCCCATGCTC TGGACCTCATGGCTCCTATGAGCTTGGAGCATGGTGAACCATCAGAGAATCTAGAACCAACCA AGCTAGGAACATCAGCCTGGTGCCCTGTTAA | SEQ ID NO: 1029 |
| LAD1 | ADXCRIH.3628.C1_s_at | AAGTGCCTCTTTGTCTATGATGTCCCCCTTCTCTGAGGCCTGGACCCACCCATCTTTGTCCCT GGGGCCTGCTCCCAGCCACTGAGGCCCGCTCTGCCAGGGGAGAAGGAGCTGCCGTGCGTCTTC CCTGTGCCCCGTCTCCCTGCTTGGTTCTCCCCTCCCTTCCCTGGCCGGCTGCCATGGCCAGGA GCTAAGTGCCTTTTTGTGTGCAACCACTTACCCTTTCTCTGAAAAACCTGTTCTCAGGAAGGA TCTGATAAACTCATTTA | SEQ ID NO: 1108 |
| LAPTM4B | ADXCRIH.1454.C1_s_at | TATATTTGATATACTTCTGCCTAACAACATGGAAAAGGGTTTTCTTTTCCCTGCAAGCTACAT CCTTACTGCTTTGAACTTCCAAGTATGTCTAGTCACCTTTTAAAATGTAAACATTTTCAGAAAA ATGAGGATTGCCTTCCTTGT | SEQ ID NO: 1153 |
| LGALS3 | ADXCRIH.184.C1_at | AATCACAAACATCAGAATGCCCAGACTGTACCGCACTTCCCGCTACTCAGAGGATTTCTCAGC TCCTGCCGGCAGAGTCCACTCCCTTCCGCCCTGGGCCTTTTGGTGAAAGGGTTACTGTGAGTG AGTCCCAGGCCTCGCTCTGCCTGGCTTTCTTCCCAAATCTGCTGCTGGAAAAACAAGGCTCCA GCTTGCAAGCCCTCATTGGACAAATGAGTCCA | SEQ ID NO: 1299 |
| LGALS3 | ADXCRIHRC.184.C1_at | GAATCTAAACCTTACATGTGTAAAGGTTTCATGTTCACTGTGAGTGAAAATTTTTACATTCAT CAATATCCCTCTTGTAA | SEQ ID NO: 1334 |
| LGALS3 | ADXCRIHRC.184.C1_s_at | AATACAAGTACTGGTTGAACCTGACCACTTCAAGGTTGCAGTGAATGATGCTCACTTGTTGCA GTACAATCATCGGGTTAAAAAA | SEQ ID NO: 1335 |
| LGALS3 | ADXCRSS.Hs#S1444631_at | TTTCTCCTGTTCCTTCCCATGTCAAGGCTCCAAAAGCACAAGATGCTTCACAGCTGTTGTAGG TGCTCCAGCAGTGAGGGGAGGAGGGCAGCTGGGCCCCTGAGGCATGGGTGGAGTTTTCTTAAG | SEQ ID NO: |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| | | CTTAGGATCACCTGTGCCATGGCCTGAATTACCTGAACCTTGAAACAACCAGAATATCCTTCT CTTTGATTTGCCCACCTGTGATATTTACTCAATCACTTTTAGAAATGGCATCG | 2069 |
| LITAF | ADXCRIH.2736.C1_s_at | TCTAGGTTGGCTGCTGTGTCATCTTTGAAGTCAAGACAAAGCTGGGCTCGACCTTCAAGGGTC CTCGTTTTGATAATACTTCAGAATAGGGAACTCATGTGAATACTACTATGTAGAAATAAAACC TAGACCTTGAGCGAACATCTGTATATTGGTTGAAAACGATAGTGGTAACCATTGATCCCCCTT CATTTGATGTTTGGAAAATTCCAGTAATTATCATTTTTGCAACGAATATGGATACCACA | SEQ ID NO: 1134 |
| LITAF | RDCR260_H04_s_at | GTAACTGCAGACTTCATTAGCACACAGATTCACTTTAATTTCTTAANNNNNNNNNNNAAATACA AGGAGGGGGCTATTAACACCCAGTACAGACATATCCACAAGGTCGTAAATGCATGCTAGAAAA ATAGGGCTGGATCTTATCACTGCCCTGTCTCCCCTTGTTTCTCTGTGCCAGATCTTCAGTGCT CCTTTCCATACAGGGATTTTTTTCTCATAGAGTAATTATATGAACAGTTTTTATGACCTCCTT TTGGTCTGAA | SEQ ID NO: 1341 |
| LITAF | ADXCRPD.553.C1_at | GTTCACCCGGTGAACTATTTATGAGTTCTTCTGGTGTGAAGAAAGGGCTCATGTTGCATTTCC AGCCATTGCTACAAAGAACCTTTATTTGTTCAGTAAGCGGTAGAAAATCCTTCCGCGATTAAA AACTTCAGACTTGCTGAATATCCTGCAATGTCAAGATGACCGATGTTGAGTTGGGTGGATTTG CTAACGAGTCAGATTTGAACATGAGGCTATTGGAACACAATAGGCGTCATTGATGGCGGCAAG CCATAGCTTTCAAGTT | SEQ ID NO: 1562 |
| LITAF | ADXCRAD_BX410303_at | AAGCACATTTTTGAGCCATGTCTGGGTACCATGGTGGCGGAATGCTTGGGGACC | SEQ ID NO: 2339 |
| LITAF | ADXCRAD_BX410303_x_at | GGGCCTGAACATAATTTCAAGAGGAGGATTTATAAAACCATTTTCTGTAATCAAATGATTGGT GTCATTTTCCCATTTGCCAATGTAGTCTCACTTAAAAAAAAAAAAAGAAAAGAAATGGATAA TTTCATCTACTGCCTTTACTTGGGGGTTAATGTAGTTCTTAAACACCTTCATCATGGAACTCT CAGAGTGGGGGTCCGTTTTTGTTTTCCTGGTGGGGGGTTTTTGAAAGAATAAGGAAAAGCAC ATTTTTGAGCCATGTCTGGGTACCATGGTGGCGGAATGCTTG | SEQ ID NO: 2340 |
| LRP5 | ADXCRPD.3405.C1_at | TGGACCCCGCTCACGGGTACATGTACTGGACAGACTGGGGTGAGACGCCCCGGATTGAGCGGG CAGGGATGGATGGCAGCACCCGGAAGATCATTGTGGACTCGGACATTTACTGGCCCAATGGAC TGACCATCGACCTGGAGGAGCAGAAGCTCTACTGGGCTGACGCCAAGCTCAGCTTCATCCACC GTGCCAACCTGGACGGCTCGTTCCGGCAGAAGGTGGTGA | SEQ ID NO: 1572 |
| LRP5 | ADXCRSS.Hs#S1910362_at | ACCTCTTGAGCGCTTTTCTATGAAGCATCCTGTTTAAGCCTCGCACTTCTGTGATGTGGAGGT GCAGTAATTATCCCCATTTCACAGACAGGATGTTGAGGTCAGAGGGGTTGAGTGATTGTCATG GGCCAGGTCTCAGCCAGGCTTGCTAACCCTGGAGTCTGGCGTCTGCTCTGAAGTGGTCCTCTC AGCTGGAGACTGACCTGGCCTTTTGCTTGTGATGTCGGCCTTAAAAATTTTGGGGGATGCTCT CGGACTTTTGGATGGGTTCA | SEQ ID NO: 2120 |
| LRP5 | ADXCRSS.Hs#S2985193_at | GGTGCTATTGAGTTCCATCATGTCCTTACTGATTTTCTAACTGCTGGATTTCACCATTTCTGA TGGAGGGTGTTGAAGTTTCCAACTATAATAGTAGATTCATCTATTCTCCCTTGCAGTTCTAT CAGTTTTTGCCTCATGTATTTTGACACTGTTATTAGGCAAATACACATTAAGGATTGTTATGT CCTCTTGGAATATTTCTTCCTTTATCATTATGTAATACCTCTCTTTAGCCTTGATAACTTTTC TTGTTATGAAGCCTGCTCTATCTGCAAGGAAC | SEQ ID NO: 2150 |
| LRP5 | ADXCRSS.Hs#S3011054_at | TGGAACCACTGTTTTACACCACAGGTTTAGGGACTGTTTGTGAGTTAAGGGTTCCTTTCGGTG ATCTGTGAACTTGGTCTTTGCAGTACCTAGATCCTGCCTTGGAGATTATTTAGTAGTGGGGAT TATTTAGATGGTATACTTAACCATTTTTCAGATGCCTGAAGACTGAACTTTAGAAGCATTTGT TAATTGATTTTATAAAATATCTTAGGACTTTTTTTCTTAACCTCATGAAAATACATTACCAT ACTGTGCTGAAACTAA | SEQ ID NO: 2177 |
| LRP5 | ADXCRAD_BM790129_at | ACAGGCCCTACATCATTGAGGAATGGCGCCCCGACGACGCCCTGCAGCACCGACGTGTGTG ACAGCGACTACAGCGCCAGCCGCTGGAAGGCCAGCAAGTACTACCTGGATTTGAACTCGGACT CAGACCCCTATCCACCCCCACCCACGCCCCACAGCCAGTACCTGTCGGCGGAGGACAGCTGCC CGCCCTCGCCCGCCACCGAGAGGAGCTACTTCCATC | SEQ ID NO: 2497 |
| LSR | ADXCRAD_BI837070_at | TTAATTGGAAGGAACACGTGAGTTGAAGCCCTGGCCGATTACCCCTTCCCGGAGTCTAATAAA AGGGTATTAATCACAAGAAAAGAAAAGAGCGAAAAGAGACGGAGAACATGCGAGAAAGGACG ACAG | SEQ ID NO: 1046 |
| LSR | ADXCRAD_BI837070_s_at | TACTCGGAGACCGACTCGCAGGCGTCCCGAGAGCGCAGGCTCAAGAAGAACTTGGCCCTGAGT CGGGAAAGTTTAGTCGTCTGATCTGACGTTTTCTACGTAGCTTTTGTA | SEQ ID NO: 1047 |
| MLPH | ADXCRPD.10614.C1_at | CTTCGAGGGAGTACTTTAAGATGACTCCACTCAGCCTCAAGGTCACTCCCTGCACATGTCCTC AGTTCCCTGAGGCTAGGGACAGCCCACTAGTCCCTCACAGATGAGTCCTGCTCAGAGTAGGCA GCCCTCACAAGGCTGAGGGCCTGGAGGAGGCTGAATACTGGGGCCTGGGTGCCACTCCAA TCCGGAAGAGCAGCCGACCAGCATCTCACCTTCCAGACACGGTCCTGGCTGAGCTCTGCCC GCCTGGAGGCTCCCACAGGATGGCCATGGATTTTTAGCTGCCATCTC | SEQ ID NO: 1460 |
| MLPH | ADXCRPD.13135.C1_at | AGGATCCGAGTGGTAGTGTTTCTGAGAGTCAGGGTCTAGGTGCTGGAGTGCGCACGGAGGCCG ATGTAGAGGAGGAGGCCCTGAGGAGGAAGCTGGAGGAGCTGACCAGCAACGTCAGTGACCAGG | SEQ ID NO: |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| | | AGACCTCGTCCGAGGAGGAGGAGGCCAAGGACGAAAAGGCAGAGCCCAACAGGGACAAATCAG TTGGGCCTCTAGCGT | 1588 |
| MLPH | ADXCRPD.15019.C1_at | AATAGACAACTTGATTCTCCTCTTCATCCTGTTGTCTTCAGGCTAGGAGACTAGGAGATGCTC AGCCAGCCAAGGATGTCCCATGGGTCTCTACCTGGCCACCCTGAGAGGTCTCTATGCTGGCCT CACCCAAGAGGTCTCTATCCTGGCCACACTGGGGAGGTCTCTATCCTGGACACCCTAGTCCTC CACTGTACCCTGCATCCACAGGTCCCTGGATGGACTTGGATGAGTTGGCTCTTCCCCTTTTCT CAGAATAACTGTAGGCCTGTGGTTAC | SEQ ID NO: 1697 |
| MLPH | ADXCRPD.1115.C1_s_at | GAAGGAGCACCCTCCACATGGACTCCCACCTGCAAGTGGACAGCGACATTCAGTCCTGCACTG CTCACCTGGGTTTACTGATGACTCCTGGCTGCCCCACCATCCTCTCTGATCTGTGAGAAACAG CTAAGCTGCTGTGACTTCCCTTTAGGACAATGTTGTGTAAATCTTTGAAGGACACACCGAAGA CCTTTATACTGTGATCTTTTACCCCTTTCACTCTTGGCTTTCTTATGTTGCTT | SEQ ID NO: 1895 |
| MLPH | ADXCRSS.Hs#S1921395_at | GTATCCAGGCAGAACGGTACCCTGAGGGCCAGCACAGCAGGAAGAAAGACAAGGACATGTGTA CTGCCCTGCATTCCAGGCTGGAGGAGTCCTCTTAAATAAGAGCCCAGAAGTGTCCTGGGGCAG CAGCTGGAGGCTGATATATTTCAGAGGCTGAAATTAGGGGAAAGGAGAACTGTACTGTGCTTT AGATTCTTTAAAACATAACTTCCCTTCTTCATAGCCAAGAGACAGGAACGGA | SEQ ID NO: 2103 |
| NR2F2 | ADXCRAD_CB217549_s_at | ATTATAATTGTTGATATTTTCCCTTTTTAAAAAATACCATTGAAATCAGCATGACAAAAATAA CACTGTTGGCACTTATAGGTAACGTGATTGATTCAGTATCTTAGAGTTTACAGTTTGTGTTTT AAAAAAACTGAAGGTTTTTTTTTAAGTGCAACATTTCTGTATACTGTAAAAGTTATAATAACT GAACTGTTTGGTCGAGTCTTTGTGTGTTA | SEQ ID NO: 979 |
| NR2F2 | ADXCRPD.4673.C1_at | GAATTGCCATATACGGCCAGTTAAAACTGCTGCCGGACAGTAACATATCCCGGATGAGGGTTT CGATGGGGTTTTACCTACCAAACGGACGAAAAACAATTGCTCTATGACTGAGGAGGAGACGG TGCGGAGGGAAGGGAGGCGAAGCAAAAGCTTTCCGAATCTCGTCGGCTGGTTGGGGTACTGGC TCCTAACGTATTCTTCCAAAGCACACTGAGACTTTTCCTGCAAGCTTTCCACATGGGCTACAT CAGAGAGACCACAGGCATCTGGAAGA | SEQ ID NO: 1691 |
| NR2F2 | ADXCRPDRC.4673.C1_s_at | ATCCGGGATATGTTACTGTCCGGCAGCAGTTTTAACTGGCCGTATATGGCAATTCAATAA | SEQ ID NO: 2001 |
| NR2F2 | ADXCRAD_CB956496_at | GCGAGCGAGATCTTTGGAGAGATTTTTTTTTTGCCTCCTACTTCTGTCTTGAAGCCAGACAA TCGACTTCAGCTCTCCCTCCCCTCCCTCTTTCTCCACGTTCTGCTCCCACTCGCTCTCCTGTC CCCTTCCCCTCCCCTCCCGGCGGAAAGCCCCCGAAACCAACAAAGCTGAGCCGAGAGAAACA AACAAAACAAACACACCGGGCCAGACAAGCCATCGACAAAACTTTGCAAAGTCAACC | SEQ ID NO: 2487 |
| NR2F2 | ADXCRAD_CB956496_x_at | GCGAGCGAGATCTTTGGAGAGATTTTTTTTTTGCCTCCTACTTCTGTCTTGAAGCCAGACAA TCGACTTCAGCTCTCCCTCCCCTCCCTCTTTCTCCACGTTCTGCTCCCACTCGCTCTCCTGTC CCCTTCCCCTCCCCTCCCGGCGGAAAGCCCCCGAAACCAACAAAGCTGAGCCGAGAGAAACA AACAAAACAAACACACCGGGCCAGACAAGCCATCGACAAAACTTTGCAAAGTC | SEQ ID NO: 2488 |
| PPAP2B | ADXCRAG_AF480883_at | GCTCGTAACAACTCTCATCTCAGGCTCTTCTAAAGAGCTTTTGTATTCTAAAGAGGATTTT TCCATCAGAGAGGTAGGAGCTGTAGGAACCCCGAGGGCAGATAAGCAGCCCTCACTCTAGATA AGGTATGCTGGGGGAGCTTACTGAGGGAATCCTGTACACAGCCCACATCAAAGGAAGGCTGAG AATGGCCTGTGGCTCC | SEQ ID NO: 788 |
| PPAP2B | ADXCRAD_CD678016_s_at | TAAACTGTGTCTCGACCTGTGTTATTTACATTAGCTGCTTAAAAAAGCATTGAGTTAATTTTT TTAAATATCAACTAAAATATCATAGTTCTGTGGTAGACATTGTTTTATAATGAAATAACTGCA ACTAGAGAAAACTGTATAAAAACATTAAATTGTCAGTATTTTTGTAAGGTTCCATTTTGTAAA GAGAATAATATTCAAAGACTTTTGTAGCATACAAAGTGAAAACTTGTATCTGCGAAACTATAC TTGTATTAAATGTGCTTTT | SEQ ID NO: 1024 |
| PPAP2B | ADXCRPD.13412.C1_s_at | ATGTTCTGGCAGGATTTGCTCAAGGAGCCCTGGTGGCCTGCTGCATAGTTTTCTTCGTGTCTG ACCTCTTCAAGACTAAGACGACGCTCTCCCTGCCTGCCCCTGCTATCCGGAAGGAAATCCTTT CACCTGTGGACATTATTGACAGGAACAATCACCACAACATGATGTAGGTGCCACCCACCTCCT GAGCTGTTTTTGTAAAATGACTGCTGACAGCAAGTTCTTGCTGCTCTCCAATCTCATCAGACA GTA | SEQ ID NO: 1641 |
| PPAP2B | ADXCRSS.Hs#S524340_at | TGACTGATAGCTGCCGCTTATGGTTACTTAGTAAAAACTCCTGTTGCTAAATGGCTCAAATGG ATGTCTGTGTGTTATTTTGCCATCTAATACAAAGCATAAATTTTTCTTACTCCAGTAGCTCA TCAAACCCTTGAATCTTTCATCATAAGCACATTGAGGCAGGAACTATGCCTGTGCCATCCTCA CACCTTTGCAAGTGGCACTCAATAAATGTTTCTCAAGTATTGTTCAGACTCAGTGAGGGTCAC ATCCCCAGGAGGAA | SEQ ID NO: 2129 |
| RRBP1 | ADXCRAG_AF006751_s_at | AGAAGAAGTTAACAAGTGACCTGGGGCGCGCCGCCACGAGACTGCAGGAGCTTCTGAAGACGA CCCAGGAGCAGCTGGCAAGGGAGAAGGACACGGTGAAGAAGCTGCAGGAACAGCTGGAAAAGG CAGAGGACGGCAGCAGCTCAAAGGAGGGCACCTCTGT | SEQ ID NO: 843 |
| RRBP1 | ADXCRAG_BC009700_x_at | ACTCAGAATCAAAGCAAAAGGCTGAAGGAGCCCCAAACCAGGGCAGAAAGGCAGAGGGAACC CCAAACCAGGGCAAAAAGACAGAGGGAACCCCAAACCAAGGGAAAAAGGCAGAGGGAACCCCA AACCAAGGCAAAAAGGCAGAAGGAACCCCAAACCAAGGCAAAAAGGCGGAGGGGCCCAGAAC | SEQ ID NO: 928 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| | | CAGGGTAAAAAGGTAGATACAACCCCAAACCAGGGGAAAAAGGTGGAGGGGGCCCCAACCCAG GGCAGAAAGGCCGAGGGGGCTCAGAACCAGGCCAAAA | |
| RRBP1 | ADXCRPD.7803.C1_s_at | GAGGCGTTTGACGTTCTAGGTTATCCCTCCGCAAGGGGATTCTCTGCCTGGCTTGCTGATGTC ATATCTGGTGGGGAGTGGATTTAGATCTGACACTTTTTCTGCTCTTCAGAAGCAGAAGCACAA GCCCAGTATCCCAATTCTGGTTTAATCTCAAA | SEQ ID NO: 1876 |
| RRBP1 | ADXCRAD_CB159041_at | TAAACACTATCCTGGGCGCAGCCCCGGGCCACCGCCGAGTGACGCCAAAGCCCTGGTTGACTC TGACAGCCCCGTGGGTGTGTGGGAGGCCGGGCGCTCTGGGGTCTGTCTGTCAGT | SEQ ID NO: 2360 |
| RRBP1 | ADXCRAD_CB159041_s_at | AAAGCCCTGGTTGACTCTGACAGCCCCGTGGGTGTGTGGGAGGCCGGGCGCTCTGGGGTCTGT CTGTCAGTGCAATCGTTTAGTGTTTTTTCAGTGGGGCGGGGCGGGAAGCGGGTGGGACCGGGC AGCCAGTTCTCAAAGGCTGTGGGGCCGACTGGAGGCCACAGCCCCTCACCCCTAGACGTTGCC AACCAGAACTGACGTG | SEQ ID NO: 2361 |
| RRBP1 | ADXCRAD_BQ778389_at | TGGTGGTGAGTTTTCGCCATCTCCTTGCGCTGGTTGGCTAGGGCTTCTTCATATGACGTTTCC TTCATGGAAAAGTCGACACCAGGAAGATGCCAATGGCAGAAACAACCATGAATCCTCCAAAG ACCACAACCCCAAGGTTTGAGTGTCGTAAATATCCATCCTGGCTTGCTTTC | SEQ ID NO: 2362 |
| RRBP1 | ADXCRAD_BQ931525_at | CCATGAGAGAACAAGTCTCCTTAGAGCCACAAGAAGTAGACCCTTCCCAGAGCCCCAGTTTT GTAAAATGAAACCCTGTGCTCCCCATTTT | SEQ ID NO: 2363 |
| RRBP1 | ADXCRAD_BQ931525_x_at | CCATGAGAGAACAAGTCTCCTTAGAGCCACAAGAAGTAGACCCTTCCCAGAGCCCCAGTTTT GTAAAATGAAACCCTGTGCTCCCCATTTTGGATAAACCACTAATCCCG | SEQ ID NO: 2364 |
| RRBP1 | ADXCRAD_CN262594_s_at | CACAGTGAAGCATCTCGAAGAGATTGTAGAGAAGCTAAAAGGAGAACTTGAAAGTTCGGACCA GGTGAGGGAGCACACGTTGCATTTGGAGGCAGAGCTGGAAAAGCACATGGCGGCCGC | SEQ ID NO: 2610 |
| RRBP1 | ADXCRAD_BE646396_at | GAGCAGAGCACATACCTGGTCCGAACTTACAAGTCTCCTTATAGCTTCTCTACAATCTC | SEQ ID NO: 2822 |
| RRBP1 | ADXCRAD_BE646396_s_at | GCAGGTCTGCACAGGGCCCGTGGCTGGGTCTCAGGGTCCTCTGAGGTAGTCAATGTCTCTCAT TAAGGAAAACAGGATGGACAAGATCCCTTGGCTTGAGAGAGAATGCCTCTCTTAAGGCACAC GGTCCATGAGGAAGAAATCAGTGAAGTGTCCTCTGCATTAACGTCACTTTCAAAGAAGCTCCC NGGACATGAGAAAGAGTTCTCTGAGCAGAGCACATA | SEQ ID NO: 2823 |
| SERPINB6 | ADXCRIH.878.C1_s_at | AGCTGCCATCATGATGATGCGGTGTGCCAGATTCGTCCCCCGCTTCTGCGCCGACCACCCCTT CCTTTTCTTCATCCAGCACAGCAAGACCAACGGGATTCTCTTCTGCGGCCGCTTTTCCTCTCC GTGAGGACAGGGCAGTCTTGGTGTGCAGCCCCTCTCCTCTCTGTCCCCTGACACTCCACAGTG TGCCTGCAACCCAAGTGGCCTTATCCGTGCAGTGGTGGCAGTTCAGAAATAAAGGGCCCATTT | SEQ ID NO: 1190 |
| SERPINB6 | ADXCRPD.16952.C1_at | CCATGTACTGGTCTGACTCATGATACAGTAGTAGAATCAGTAGAAGTGATGCTGTACAGAGCT AGGCCCTTTTTAAAAGGCTGACAGCTGCCATGTTCACTCTCTTGTACACTGGCACCATGACA GAAGGAAGTCCAGGCTATCCTGCCGAAGCA | SEQ ID NO: 1386 |
| SERPINB6 | ADXCRPD.11180.C1_at | ATCCTGCTGCAACAAGCCAAGCCTTCCTGCGCCTGAACTCACAGCACACTCAGGACACCACCT TGCCTCATGGGCTGTGGGTGCATGCCCATCTACACCTTCACAGACAGGCTCACGGGTAGGGTC AGGCTGCACATCTCTCTAGCCCTGCCGTGCAGTGGGTGTGGCAGCCCCAGCAGGGTCCAGAGC AGGAATGCAGCTGGATAGTCGGGAGGGGGGAGCTGGGGTATCTTCAGGCAAGTCGGAATCACA GAATCACATGTTAAAGTCCACCAAGCCCTTAGAGAGACCTACCATCA | SEQ ID NO: 1436 |
| SERPINB6 | ADXCRSS.Hs#S2986702_at | TGCCCTGAGGCCATCTCTTTTAGAATCTTTTGCCAGCTGGAAAGGCTGGGAAGAAGAAACATT TTTATTCTCCACCCAGTACATCCTGGATTGGAAATAGTTCCTTTAAATTCTGCTTGAAAATGG AACAGTTCCTTCATCTTTCTCTTCCCATGTGTTACCCTAGGCAGCAAAAAGAAGCCAGCTTCC TCCTGGACCCCTTAGCCAGATGCAGGAGTTCCCGGGGAGGCACTCCATCCTCCCTGTCACTG AGGGTGACCTTCTTTCCACTT | SEQ ID NO: 2167 |
| SFN | ADXCRIH.2281.C1_at | CAGAGCTGAGTGTTGCCCGCCACCGCCCCGCCCTGCCCCCTCCAGTCCCCCACCCTGCCGAGA GGACTAGTATGGGGTGGGAGGCCCCACCCTTCTCCCCTAGGCGCTGTTCTTGCTCCAAAGGGC TCCGTGGAGAGGGACTGGCAG | SEQ ID NO: 1253 |
| SFN | ADXCRIH.2281.C1_x_at | CAGAGCTGAGTGTTGCCCGCCACCGCCCCGCCCTGCCCCCTCCAGTCCCCCACCCTGCCGAGA GGACTAGTATGGGGTGGGAGGCCCCACCCTTCTCCCCTAGGCGCTGTTCTTGCTCCAAAGGGC TCCGTGGAGAGGGACTGGCAGAGCTGAGGCCACCTGGGGCTGGGATCCCACTCTTCTTGCAG CTGTTGAGCGCACCTAACCACTGGTCATG | SEQ ID NO: 1254 |
| SFN | ADXCRPD.9737.C1_at | TGCTTTTCTGCTCAATACTGGACAGCACCCTCCAGGCAGCCCTCTGGCCGCCCACCACGTTCT TATAGGCTACTGAGAGCAGGTTTCGCTCTTCGCAGGAGAGCTCCTCGCCCTTCTCCACGCGC CTTTCATGAAGGCTGCCATGTCCTCATAGCGTTCGGCCTGCTCTGCCAGCTTGGCCTTCTGGA | SEQ ID NO: 1506 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| | | TCAGACTGGCTCTCTCCATGGCTCTGGGGACACACAGCGGGCGGCGGGCTAACTGCTGCCTGGCCTCGTG | |
| SFN | ADXCRPDRC.9737.C1_at | CCCAGAGCTGAGTGGTGCCCGCAAACCGCCGGCTGCCCAATCAAGTACCACAACG | SEQ ID NO: 1949 |
| SFN | ADXCRPDRC.9737.C1_s_at | TCTTCCACTACGAGATCGCCAACAGCCCCGAGGAGGCCATCTCTCTGGCCAAGACCACTTTCGACGAGGCCATGGCTGATCTGCACACCCTCAGCGAGGACTCCTACAAAGACAGCACCCTCATCATGCAGCTGCTGCGAGACAACCTGACACTGTGGACGGCCG | SEQ ID NO: 1950 |
| SFN | ADXCRPDRC.9737.C1_x_at | TCTTCCACTACGAGATCGCCAACAGCCCCGAGGAGGCCATCTCTCTGGCCAAGACCACTTTCGACGAGGCCATGGCTGATCTGCACACCCTCAGCGAGGACTCCTACAAAGACAGCACCCTCATCATGCAGCTGCTGCGAGACAACCTGACACTGTGGACGGCCGACAACGCCGGGGAAGAGGGGGGCGAGGCTCCCCAGGAGCCCCAGAGCTGAGTGGTGCCCGCAAACCGCCGGCTGCCCAATCAAGTACCACAACG | SEQ ID NO: 1951 |
| SFN | ADXCRAD_CN335041_at | CCCTGCTGCCTCTGATCGTAGGAATTGAGGAGTGTCCCGCCTTGTGG | SEQ ID NO: 2754 |
| SFN | ADXCRAD_CN335041_s_at | CGCCTTGTGGCTGAGAACTGGACAGTGGCAGGGGCTGGAGATGGGTGTGTGTGTGTGTGTGTGTGTGTGTGTGCGCGCGCCAGTGCAAGACCGAGATTGAGGGAAAGCATGTCTGCTGGGTGTGACCATGTTTCCTCTCAATAAAGTTCCCCTGTGACA | SEQ ID NO: 2755 |
| SFN | ADXCRAD_CN335041_x_at | CCCTGCTGCCTCTGATCGTAGGAATTGAGGAGTGTCCCGCCTTGTGGCTGAGAACTGGACAGTGGCAGGGGCTGGAGATGGGTGTGTGTGTGTGTGTGTGTGTGTGTGTGCGCGCGCCAGTGCAAGACCGAGATTGAGGGAAAGCATGTCTGCTGGGTGTGACCATGTTTCCTCTCAATAAAGTTCCCCTGTGA | SEQ ID NO: 2756 |
| SLC25A1 | ADXCRAD_CN295781_s_at | ACTGTGTCCCAGTGTCTGGCCCAGCCATGGCTGGATGTGCATCTGGCCTATGACCCTGTGCCTGTGTTTCATGTTCTGTGTCACGTGACCCTGTGCCCCGCCTCCCGGGGTGCCCGTGTGGCCTGGGTCCTCGGCCCTGTAGCCCTGGCCCGGTCCCAGTCCGGTGCCTTCCACCCTGCCCTGGCCTACCACAGCTGCCTCCGGGCCTCGGCCTGGCTTCACCGCATTCCAGGGGCTGCAGCCCCCTGCTTCTCCCGCCATTGGCCTTAACTGGCCCTCGGGC | SEQ ID NO: 2501 |
| SORL1 | ADXCRAG_U60975_s_at | TGAAGATGCCCCTATGATAACTGGATTTTCAGATGACGTCCCCATGGTGATAGCCTGAAAGAGCTTTCCTCACTAGAAACCA | SEQ ID NO: 1069 |
| SORL1 | ADXCRPD.18092.C1_at | CTGGGTTGCCAAAGGTAAAATATATAAAAGAGAAGCCTCTGACTTGGTTCCTGCTTCTGGTCTCTCTCCATCAAACGCATTCTGCCCACTACTTATCCTTCCCAAAGATGAACTTTCATCACATGACATCAGTGGTTCCCAACTGCTTCTCCGATAAAGTCCACAAAGCCTTTCTGTCCTGGCGCTGCCCACTCATCTAACTTCCACCTTGCACCCTGTGCCCATGCCCATTCTCCATAACTCAAACCAGTTTCCTGCCAT | SEQ ID NO: 1871 |
| SORL1 | ADXCRAD_BX089897_s_at | TTTCTTCCCCGACTGAAAGATGGCTTTGTCCGTTGAGTTGAAAACTATTAAGTCCTGCCTTCCTCACTTTTCATCACGTGGCTTCTGTTTTTGAATTCCTTTTTGTTTTCAGTGATCCCACCACTAGATATCCACATTGACAGCTATGGTGAAAATTATCTAAGCTTCACCCTGACCATGGAGAGTGATATCAAGGTAATGTGGGAATTTCAAGCCAGCAGCTGGATGGGGCTTTATTTTGTATGGGAACTGAAAGGACATAGCACAGTAAGACTGG | SEQ ID NO: 2476 |
| SQLE | ADXCRAG_AF098865_at | GATTGTTACCATAAATTAGTGCTAATGCTGAGGAG | SEQ ID NO: 856 |
| SQLE | ADXCRAD_CB106889_s_at | TGGATTACAAAACCTCGAGCCCTTCTCAGTAGTGGTGCTGTATTGTACAAAGCGTGTTCTGTAATATTTCCTCTAATTTACTCAGAAATGAAGTATATGGTTCATTAAGCTTAAAGGGGAACCATTTGTGAATGAATATTTGGAACTTACCAAGTCCTAAGAGACTTTTGGAAGAGGATATATATAGCATAGTACCATACCACTTATAAAGTGGAAACTCTTGGACCAAGAT | SEQ ID NO: 857 |
| SQLE | ADXCRPD.8241.C1_at | CAGAGGCTTCTTTTTCCGCGACGGAGACACTGTACAGCCCAACCTCGGGAAAACGCCAACGCAGACGGATTCTCCAACAAAAGATGGGCTCGGACTCAAGAGTGCGGCTCCAGGGCAATGCAGCCCAACCTAAAGATTTAGAAGGCTTCCCGTTTTCGTGGGCGCCAGAGCCGCCCACGGCGACTGCAGTTTCCCACCGATTAAAGGTGGGTTTCACGGTAACTCCCTCAGATTGCGGCGGCGATTCCCGACGGGTTCTCAACAGCAT | SEQ ID NO: 1825 |
| SQLE | ADXCRPDRC.8241.C1_s_at | TTTCCCGAGGTTGGGCTGTACAGTGTCTCCGTCCGCGGAAAAAGAAGCCTCTGAACCCGGGCCGGCCCGCAGCCCCCGTCGTTTCCGGCCGCTGCTCGCCGTCGCCCAGAGGCTAGGCCACGTTTTCCCCCAGTGCCGAGGTGTTTCTGTGACCCCTCCCTCCACTCCCATTCCCTTCTGAAAGGGCACCTGCTCTTGGTGAGAAAAGAAATTATAGCACGAAGAGCCAGTATCAGAAGAGTATCCATCACCCGCAGCAACCGCTCAGGGAACACCAT | SEQ ID NO: 2031 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| SQLE | ADXCRAD_BU754109_at | GTATAAGTCCCTGTACTTCAATGAAACTAATTCTTAAATTAAAATTTCTCAATTATTCCTGGC TCCCACAGACCAGAACATATGGATAAATCCATAGGCAAAAAACAAGCTTCTATTTTAATCAAG GGTTATATAGCTTCCTCTACCACCTTTAACTGCTGTTCCCTAGAAAGAAAACAGTACTAAAT ATTGCGTTTCTTCATTTCTTTGGGCCACCTTCTCATTGGGATACTAACAGATAATAAAATATC AAAATGTGTAAGGAAGAAAGATTTGCAGTAATTCCCTCGTGCC | SEQ ID NO: 2783 |
| SQLE | ADXCRAD_BF979497_at | GCCCTTGGGACCTCACTTGTGGGAACCTTAACCCATCGAGACAGAAATCCGGTGACGGCGCCA AGAAGCTGGACCAGGGGCTTCGGCGTCGACCACACCTGTTAGAGCCGGACCATGGCCCGAGCC GCGGCGGGGCCCCGGAGGCCACAGGCCAAGGCGGGCGAGGCAGCGCTCGAAAACACGGTGACC CCAAGAGGGAGAAGCCACTAGCGCAGAAGGGAA | SEQ ID NO: 2867 |
| SUV420H1 | ADXCRAG_BC002522_s_at | GGGTGCTCTCTTCCACTACAGAGAATCCTGAAGAAAAGGGAAGGTGTTTCCCATGATGGTGAA TGTCACTGCCATGAATTCCTGAATCTACCTGCTGCTGGGAGTCAGAGTCCAAGCATAACCCGT GTAGCATAAAAGCAGCGCTGTAGCCCTATTCCAGTCTTTTTCGTTAATGTCCAGAGTGAACAA CAAGAGTTAGTCAATCATTAACTGTTGACTGTTGATTCTCATAA | SEQ ID NO: 915 |
| SUV420H1 | RDCR087_E11_s_at | CTTTATGTTCAATACCAGGTTCTTTTCATTTCTCTGGATTATTTTGCAAATCATTGGACAGAG AATTTGGGAATATAAATCTGTAACAGGTGTTTGACACCAGTAAGTCTCTTTATTTCTGGGAAA TGTGTACCTGTACTTTCTGATATACAGTGTTCCTAAGTAAAAATCAATTCACGGGATTTGTAT AGTGTCTATAGGAAAGTAGCC | SEQ ID NO: 1362 |
| SUV420H1 | ADXCRPD.8158.C1_s_at | GATGACAACAAGCAACATTTATCTAATGAACTACAGCTATCTTAATTTGGTTCTTCAAGTTTT CTGTTGCACTTGTAAAATGCTACAAGGAATATTAAAAAAATCTATTCCCTTTAACTTATAATA GTTTATGAAATAAAAACATGAGTCCCAGCTTTTGTTCTGTGGTAACCTATAAAAAAAGTTTGT CTTTGAGATTCAATGTAAA | SEQ ID NO: 1811 |
| SUV420H1 | ADXCRSS.Hs#S2577958_at | GTTCTTTATTACCAGCTTGAATGGGCAATGCCGCTAAAGATTTTAAGGCAGATTTAAGTAGTT TTCAATTTGAGTAATTTTTCTTGCTTTGGCTTTTCACAGGTAATGGTAACTCGGGATTTGAAG GACAGAGTCGCTATGTACCATCCTCTGGAATGTCCGCCAAGGAACTCTGTGAAAATGATGACC TAGCAACCAGTTGGGTTCTTGATCCCTATTAGGTTTTCAAACACACAAAATGAATACTAGGTA ATTTTCAGTCTTTATCCTGAATGAACAGA | SEQ ID NO: 2132 |
| SUV420H1 | ADXCRSS.Hs#S2577958_s_at | ATGGTAACTCGGGATTTGAAGGACAGAGTCGCTATGTACCATCCTCTGGAATGTCCGCCAAGG AACTCTGTGAAAATGATGACCTAGCAACCAGTT | SEQ ID NO: 2133 |
| SUV420H1 | ADXCRAD_BQ722638_at | TGCAGCATAACGACCACACAAACCACCACANATATTGTCCCCCCCTTGCGCCCCCCCCCCTTC CTCCCCCTTTCATCCCCGGTCCTTATCCACAACCCCCCCGGGGGAACATGCTCTTCCAATAAT CCCCTCCCCTCCTTACCCACGGGGGCCTAACAAGGTAAGGTGGCAAAATAACCTCCCCCGCCG CCCCCCCTTTATTTAAACACCCCTGTCCCGGCCGAAAACTCTGCCATGCGTGCCACCC | SEQ ID NO: 2350 |
| SUV420H1 | ADXCRAD_NM_017635_at | AAAAGTCCAGTGGAGAAAATCTCAATGCTTACTGTTACTACTAATTGATTCCTACTAGTTTCC AGGTTTG | SEQ ID NO: 2768 |
| SUV420H1 | ADXCRAD_NM_017635_x_at | GGTGTTTGACACCAGTAGGTCTCTTTATTTCTGGGAAATGTGTACCTGTACTTTCTGATATAC AGTGTTCCTAAGTAAAAATCAATTCAGGGGATTTGTATAGTGTCTATAGGAAAGTAGCCCATG TCTTGAAATATGAAAAGGAATCTGAAGGTCATGAAAAGTCCAGTGGAGAAAATCTCAATGCTT ACTGTTACTACTAATTGATTCCTACTAGTTTCCAGGTTTG | SEQ ID NO: 2769 |
| TCF7L2 | ADXCRAG_BC032656_s_at | GTGCCATGTGGCTACATTAGTTGATGTTTATCGAGTTCATTGGTCAATATTTGACCCATTCTT ATTTCAATTTCTCCTTTTAAATATGTAGATGAGAGAAGAACCTCATGATTCTACCAAAATTTT TATCAACAGCTGTTTAAAGTCTTTGTTAGCGTTTAAAAAAATATATATATATACATAACTGTTAT GTAGTTCGGATAGCTTAGTTTTAA | SEQ ID NO: 955 |
| TCF7L2 | ADXCRPD.1966.C1_at | TTAAAGAGCCCTCCATCTTGCCTCTTGGCCGCTTCTTCCAAACTTTCCCGGGATTTGTCTCGG AAACTTTCGGAGCGAGGCGGAGGCCGTCTTTCCGCCTCGGAATCGGAGGAGCTGTTTTGATTC GTTTCTGATTCATTGACTAGAGACGATTTGACATCAGCTAAATCCCTCTCTGCCGAGGAGTTT TCGGAGCTCTTCTCCTCCTGTTCGCCCTCGTCTTTGAAGGAAATCAGTTCGTCGTTGGCGC CTAGGTCA | SEQ ID NO: 1536 |
| TCF7L2 | ADXCRPD.16751.C1_at | CGGTACTATACTTCTGTGCAGGCAGGTTCTGGTGTTGGGGACAAGGGTGTGAGTGAGAGGACT GAGTTGTTGCCTTTAGGAAGTGTACCGTCTAGCCAGGAGTAACGGCTTGAGTCGAAGTCGGCT CCCATTGGGCCTCTTAGGGAGTCCCAGTTTGCTCTGAGGCCTGCTCCTCTCTGGGAAGAAATC ACCTTGAGAGCTTCTGGGATTTGGAACTCCCTGCATGGTTGGATCCCTTCCATCTTCATGTGA ATAGTCTTGGTAATGAGGCTGCCC | SEQ ID NO: 1852 |
| TCF7L2 | ADXCRSS.Hs#S11047314_at | TTGCTCCTTGGGACAACTGAAGAATCCTTAGATAATTAATAGTATGAAATACTGCCCTTTTAG TTGAAAAATGTCACAATAATGTAATAAGATAAATAAGGAGGTGTCGCTTTAACCTGTATCGTG TAGTCTCCTCTACTTACTAACACTTACTTGTATTACTAGAAGCATTATTTTTTAAATCATGGA AAATTGGTGGCAAGCTGAGCATACAGTTGTTTATTTCTGTTTGACTGATTATTACAACTTCAT TATTTGATGAAGGTTCTGTACGTTTTCCTTTAAGACACATA | SEQ ID NO: 2081 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| TCF7L2 | ADXCRSS.Hs#S1920919_at | TTTCAAGCAAACCACATCATTACCCACAGAGGCCATTGGTGAGATATTTGTAAGTCTCCTGAC AGTGGCTGGAGTTCGTTGCTTGGTAGTAGTTTCTCTGTCTCAGCCCTGGAGATGGGAGTGACC ACCTGCTCTCTCTGGACAGAGGCTGTCCACGTTCATGCAATTCCTTGGACACCGGTGGCGCAG CGGGAGGCGTAACTGGGAGTGGGAGACCCTGAACTGTGCCGGTTCTTGCAGAGTATCAC | SEQ ID NO: 2099 |
| TCF7L2 | ADXCRSS.Hs#S3013361_at | CGTCCTTTATGTGGCACACCCTTAAGGGAGACATCTTCCTGTCTGTGTATTGCACCCTCTTAA AACTACATTCCTTTCCCTTCAGCATTGGCATCTCTGTCCTTGTGTATTACCTGGGATGACTAT TCAGTTAACAAATGCTTTCTTCCTAGGCTGTGAGCCCCAGTTTGTTGGATGATTGGATGGAGG CTATCAGCGC | SEQ ID NO: 2171 |
| TCF7L2 | ADXCRSS.Hs#S3742718_at | TGTGAGTTGTACACCATGACTGGAATCGCTTGGACATACTCTTCAGCAGACATCGTGTGACTG TGGAAGAAATGAGTTTCATGAAGATGACTGATAGAAGGAAGCCACTGAACCAGTCCTCTATCT CCTCTTCCAAGGCTAAAGTTTGGAGCCACTTGCAGAAGGCTCTCCTCAAACCCCTGTGTTCTT TGCCTACCCCTGCTGTTGCCACATCATCTTGGAGAGCTGGCTGC | SEQ ID NO: 2192 |
| TCF7L2 | ADXCRSS.Hs#S3891559_at | GAGGGCGAGCACAATTTTACACAATTTACTGGCCAACTGTGGGCGAACAGTGCGGGGGCATAA GCGGGGTGGGATTTTTTGTGGGCGAATCTTGGGATGCGCCAGAGATGGGGGGACAATTTGAGT GTCGGGGAAAATCTGTTTCCTTTTATTAATTTCATAGAGTATTGCCTTGGTCATTTGTCTATG AGAGATTTTCAATAATAGAGTGCTTGGCGAACACACATAATCTGGGGGATGGCGATAAAGGA AAATTTAAAACATACTTCATTGCGGGCCGAGACT | SEQ ID NO: 2219 |
| TCF7L2 | ADXCRAD_AU118429_s_at | AGAAGCCCCACATAAAGAAACCTCTTAATGCATTCATGTTGTATATGAAGGAAATGAGAGCAA AGGTCGTAGCTGAGTGCACGTTGAAAGAAAGCGCGGGCATCAACCAGATCCTTGGGCGGAGGT GGCATGCACTGTCCAGAGAAGAGCAAGCGAAATACTACGAGCTGGCC | SEQ ID NO: 2539 |
| TCF7L2 | ADXCRAD_BU173366_s_at | AATTCTGTATATTAGATTACTCTTAAACGAAAAACCAGCTGCCGCTTTTATGTACACATATTA CATACGAGTAGCAGCAGACTTTAAAAATAAAAAAACCTAGGCATGTTGATGTTGCAAAATGC TGTATAAAGCTGAAACTGGTCATTCAGTGCCATTGTAGTTGACATGAAGCGATTGTAAAACTG TCTCCGATTTTTCTCTGGTT | SEQ ID NO: 2575 |
| TCF7L2 | ADXCRAD_AV758440_at | GTATAAAGCTGAAACCTGTTCATTCAGTGCCATTGTAGTTGACATGAAGCGATTGTAAAACTG TCTCCGATTTTTCTCTGGTTATTAAAATGCTAACTATAACATTTTTTGTGAATACTTTGAAT GTTTCCTAACAGTTGTGATGTTACTGTTCCGTTTTATGCTCTTATTCCAAGTTCATTTTTAAT GGTTTGGAAGCCATTTTTGTAATGAATAAATGTTCATGCTGTACAGTATCTGTAGCATGCCGT TCTGGATTAATAA | SEQ ID NO: 2665 |
| TCF7L2 | ADXCRAD_AA664011_at | AAATCGGAGACAGTTTTACAATCGCTTCATGTCAACTACAATGGCACTGAATGAACAGGTTTC AGCTTTATACAGCATTTTGCAACATCAACATGCCTAGGTTTTTTTTATTTTTAAAGTCTGCTG CCTACTCGTATGTAATATGTGTACATAAAAGCGGCACGTGGTTTTTCGTTTAAGAGTAATCTA ATATACAGAATTTTGGCACGTAAAAGTTTTGTACACGGTCAGTCCGGGTCCTAAGGGCGCAGGG TAGGGCATCCCACTGGGAGTTCAA | SEQ ID NO: 2880 |
| TGFBR3 | ADXCRAG_NM_003243_s_at | AACTGTAGCAAGATGCAAATGCATGGCAAATCTGTCGGTCTCCAGTTGGTTATCTGAATAGTG TCACCAATTCCACCAAGACAGTGCTGAGATTGGAAAGGGCACTCATTTGGATTGCCTTACTTC TCTTGCCTTAAATATATCCCATATATTTAATATGTCAAAAGGGCTTGAGGTGAATTTCATTA AATGGAATAATATGATGCCACTTTGCAGCTAAAATAAGCTCAGTGATACCTCCTTGTT | SEQ ID NO: 1021 |
| TGFBR3 | ADXCRIH.3170.C1_at | ATAAGGTATTTTCTCCCTAGCTTCTCATTTACAGTATTTCTAATTGCTTCACACTTTACAGTT TTAATACAAAGTACAAGCTCTACTTTTATAACGTGTACTACAAGTTTCTTTAAAAGAATGTTG TATTTTCAGCTGACCTCTTGTATCTTGCATTCTTTGTTATTTTCTGCAGGCTACCCC | SEQ ID NO: 1206 |
| TGFBR3 | ADXCRSS.Hs#S624533_s_at | AAGATTGATGTCTTAGAAGGACAGGGTTAAAACCTTCTGTAATATATTTAAATATATATTTTT AAGAGAGATGCTACATTGCCAATGATTTTATAAATAATTTAAAATTAATTTACAAATTTATAG ATGCAAACCAAAAGATCTTTTTAAAAGAGAGAGAGGAAAAAAATCACCTTTTATTTGTTTG GGTCTCATTGTCAGAATTATTATTCAGATCAAGAAACCTGTGTCGATAAAACCTAATCATA TTGGAGAGTGAATGTCGTTAAGTATTCTGAA | SEQ ID NO: 2187 |
| TGFBR3 | ADXCRAD_BF664880_at | CCGGTAAGCACGACGCAACGAGCGACAGACACAGAGCCGACAGCAGACAGAAAGCGCAAAAGA GACAAGCGAAGACGGCAAACAACGCGGAGGAGAGACGGCACCAGCCCGAAGGCGAGAGCAAGC GCACCAGCGACAGAAGAAGGAAAGCAAGAAACCACAAACAGACGAGCCAACAAAACAAAAAG AAGAGACAACAGAGGAACGACACAGACAGAACCAGCACAGAAGAAACACAACAGAGAAAC AACGGGACCAA | SEQ ID NO: 2432 |
| TGFBR3 | ADXCRAD_BF677896_at | ACAGTGGTGTGAAGAACCCCAGTAAGGTATTTACTTTCCACTGTACTCATATGTTTGGTTGAA CTCTTAACTCTATCCTTATTGGTTATTACTTGTTAATTCTGAGTTTCCCTTTATAAACTTTCC TAAAAAAAAAAAAAAAAAAATTGGGGGCGCGCGCAGAAAATTTAACACCATTG | SEQ ID NO: 2632 |
| TGFBR3 | ADXCRAD_BF677896_x_at | TATGACTGTGAGACTTTTCCAAGGGATTTTTTAAAAAACACATTAGGCTTTGTGCAGAAGTA AAGAAACAGTGGTGTGAAGAACCCCAGTAAGGTATTTACTTTCCACTGTACTCATATGTTTGG TTGAACTCTTAACTCTATCCTTATTGGTTATTACTTGTTAATTCTGAGTTTCCCTTTATAAAC TTTCCTAAAAAAAAAAAAAAAAAAATTGGGGGCGCGCGCAGAAAATTTAACACCATTG | SEQ ID NO: 2633 |
| TGFBR3 | ADXCRAD_AW268884_at | GAAGTTGGATTCAGTCGTCCTGGCTCTGCCATTAGCCCCATCCCTGGAGTTTAAAAAAGCAAGT CTTTTTAACTTCTTGGAGTTCAGTTTCCTCACCTGTGAAATGAAGAAGCTGAATAAGCTCATC | SEQ ID NO: |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| | | TTAGGGTTATTTGCTGCTCCAACAGTCTAATATTCTCTGAGGAACAATATGCTTGGGTTCATG GGAGAGTCACTTCCCACAGGAACCACGCTGACCAGAGCACCTGATTGCTAGCCTCTCTTCTCT GGA | 2838 |
| TGFBR3 | ADXCRAD_BF439431_x_at | GGTCTTATTCTGTCACTCAGACTGGAGTACAGTGGCATGATCATAGCTCACTGTGGCCTTGAA CTCTGGGGCTCAAGCAATCCTCTTGGTGGTTTTAAAAATTTTTGTAGAGACAGGAGTCTTGCT ATATTCCCCAGGCTGGTCTTGAATTCCTGCCTCAAGCAATCTTCCTGCCTTGGCCTCCAAAAG CATCAGGATTACAGAAGTGAGCTATCATACCTGACTCAAATATTA | SEQ ID NO: 2895 |
| TJP1 | ADXCRAG_L14837_at | TCTGTTAATCATTAGGTGTGACTGAATTTCTTTTGCCGTTATTAAAAATCTCAAATTTCTAAA TCTCCAAAATA | SEQ ID NO: 993 |
| TJP1 | ADXCRAD_BM352913_s_at | TTGAGCCTTGAACTTTGACCTCTGCAGCAATAAAGCAGCGTTTCTATGACACATGCAAGGTCA TTTTTTTTAAGAAAAAGGATGCACAGAGTTGTTACATTTTTAAGTGCTGCATTTAAAAGATAC AGTTACTCAGAATTCTCTAGTTTGATTAAATTCTTGCAAAGTATCCCTACTGTAATTTGTGAT ACAATGCTGTGCCCTAAAGTGTATTTTTTTACTAATAGACAATTTATTATGGCACATCAGCAC GATTTCTGTTTAGATAATACACCACTACATTCTGTTAAT | SEQ ID NO: 994 |
| TJP1 | ADXCRIH.3943.C1_s_at | AAGGTGAAACACTGCTGAGTCCTTTGGTGATGTGTGGTCCCCATGGCCTCAAGTTCCTGAAGC CTGTGGAGCTGCGCTTACCACACTGTGCGTCCATGACTCCTGACGGTGATCCTAAAACCTGGC AAAACAAGTGTCTTCCCGGAGATCCAAATTATCTCGTTGGAGCAAACTGTGTTTCTGTCCTTA TTGACCACTTTTAACTCTTGAAATATAGGA | SEQ ID NO: 1240 |
| TJP1 | ADXCRPD.11593.C1_at | TGGGCTTCCGGTCTGAGTCTACCATGTGTGTCATACCCAGGAGCTGGCTGCTCTTCGTGCCGC AGGGCGGATGCTCTAGGTGCCTGTTCGTAACGTGGTCTGCTGTCGTAAGACAGAGGGGCTGGC TCTTCAAAACGTGGAAAGTACCCTCGTTCTGAGGACTCTTCGGGATGCTGTCTGGAGTCAAGG TCTTGAGAGTGCTGATTATCAAAAGGTGGCCGAGATGGGTAGGGCTGTTTGTCATCATAATAT GACCACTGTTCTTCATACATGGG | SEQ ID NO: 1531 |
| TJP1 | ADXCRPD.14975.C1_s_at | TTAAATGCACCTGGAATATATAACCAGTGTTGTGGATTTAACAGAAATGTACAGCAAGGAGAT TTACAACTGGGGGAGGGTGAAGTGAAGACAATGACTTACTGTACATGAAAACACATTTTTCTT AGGGAAGGATACAAAAGCATGTGAGACTGGTTCCATGGCCTCTTCAGATCTCTAACTTCACCA TATTACCACAGACATACTAACCAGCAGAAATGCCTTACCCTCATGTTCTTAATTCTTAGCTCA TTCTCCTTGTGTTACTAAGTTTTTATGGCTTTTGTGCATTATCTAGAT | SEQ ID NO: 1769 |
| TJP1 | ADXCRPDRC.11593.C1_s_at | AGATCTGCATCCTTAGAGACCAAGAAGGATGTAAATGACACTGGCAGTTTTAAGCCTCCAGAA GTAGCATCTAAACCTTCAGGTGCTCCCATCATTGGTCCCAAACCCACTTCTCAGAATCAATTC AGTGAACATGACAAAACTCTGTACAGGATCCCAGAACCTCAAAAACCTCAACTGAAGCC ACCTGA | SEQ ID NO: 1959 |
| TJP1 | ADXCRSS.Hs#S2984021_at | TAGTTCAAAGCAACCCATCGTTCTTGCTTACATCTGCATTTCAAACCAGCTTTAAAAACTTAA GTGGATTGATTAGTTCTAAGTTATTCTTGCCCAGACTTTCATATATTTCCTTGACTGGCTACT GGATTATAGTATTCCGAACCCTGGCCAGCTTAAGATTAGAGTAGATAGCAAGAAGACTTTTCT TCTGCAACAGCTGTTACCGAGTTTAGAAGCCCTTTAGCTTGTTCCGAGGGATTGTGCTCTTA CAGGATAGATCCCTGGATTCCCACTC | SEQ ID NO: 2152 |
| TJP1 | ADXCRAD_BM674772_at | TCTGCCTCTACTAAATGGCTCCAAACAGCTGCAATTTCACAACCAAAGTTTTTTACTTGAAAC AGCATGTTACTCCTTGCTAATCTAATTGAGTGTGTATTAATCGGCTACACTGGTCACACATTT GATTGGGTAAGACCTAAAGTAGGCTCTGCTTAACAGTGAGTCCGTTCATGTGACCTATAAAAT CTCTCTCAGAGACTCCTTTCCAGTCCATCTTTGTCAGCTGTCTTGTCTAGAGCTTTCAACTAG CTCATAGCCTCCAGATAACAAGGTCCTCGTGCCGAA | SEQ ID NO: 2599 |
| TJP1 | ADXCRAD_BM674772_s_at | ATTGAGTGTGTATTAATCGGCTACACTGGTCACACATTTGATTGGGTAAGACCTAAAGTAGGC TCTGCTTAACAGTGAGTCCGTTCATGTGACCTATAAAATCTCTCTCAGAGACTCCTTTCCAGT CCATCTTTGTCAGCTGTCTTGTCTAGAGCTTTCAACT | SEQ ID NO: 2600 |
| TJP1 | ADXCRAD_CN372474_at | TGACTCCTGACGGTTGGTCTTTTGCTCTAAAATCATCCGACTCCTCGTCGGGTGATCCTAA AA | SEQ ID NO: 2668 |
| TJP1 | ADXCRAD_AL109707_at | ATTACCGATGGTTGATGGACATGCCAAGGTATTGACCTCTTAAGCCAGTAGTGGCTGGTTAGA GCTTGGCAAAGGAGCAGCCCCCTCAGTTTATCTCAGTGTGCCATACAAATAATATTTTCTCTG GATGTTACAGTGTGAAAAAGGGTGGGAAGTAGTGCCCTGTTGAGCCATATTAGAGCCCCAGGC AAAAGAAA | SEQ ID NO: 2830 |
| TJP1 | ADXCRAD_AW173166_at | GGGTAAACAACTATCTGATGTACATATTCAACTGTCACTGAGGACCAGTAGAGAGATCAGAAT CCATGAGGAGGCAAATTCTGCCTGTTTTTTTCTGATATAATTCCAGGGCCCACAAGAGTACAA CAGTGCTTGGCATACAGTAGAACACTAAAAAATTACTTAGTCTTTAAGAATGAATAGGGTTTC AATGGTTTCTAGAAATATAAGATGAAGAAAATATCTTCTGGAAATACAAATGAAAGAATGAAG CATATATTATTCTAGACAGTAAA | SEQ ID NO: 2897 |

TABLE 10-continued

Genes and corresponding Almac probesets predicting resistance to irinotecan. There can be multiple Almac IDs/probesets associated with a given gene.

| Gene | Almac Probe ID | Probe Sequence | SEQ ID NO |
|---|---|---|---|
| TMEM97 | ADXCRAG_BC045655_s_at | CTACAGCCAGGCATAACATATCCACTGTGTGCATAGAGGGTCTCTTCACGTTGATGCTTGGCA TTCCATCAGCTTTCTCTAAGTCTTTGCTCAAGTTCAACCTTAAAATGATGTTAG | SEQ ID NO: 966 |
| TMEM97 | ADXCRAD_CX867137_s_at | TTAATTTTCATGTTGCGGAGCCCCTACTACAAGTATGAAGAGAAAAGAAAAAAAAAATGAAGG AAACAACCACTGGCCCAGGGTAGAGATGCCTACAGGGTGGTTGCTTGTTGGATACAATACAAG GAACACTGCTCAGAACCCACGTCTTCAGCAGCATTTGAAACACTGGCAGCAATGCACAAGAGC AAGATGGTGTCAGGAACCATGTCAAACCCTC | SEQ ID NO: 2532 |
| TMEM97 | ADXCRAD_BU857068_at | TCTTCCTGCCAAGAAGAATGGGGGATTCCATTCCTTGAGGGATTATGCCAAATTAACAAGAA TCTCGGGGGAAACACAGGATAAAT | SEQ ID NO: 2566 |

TABLE 11

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| HNRNPA1 | 200016_x_at | AACTCGAGGACTGTATTTGTGACTAATTGTATAACAGGTTATTTTAGTTTCTGTTCTGTGGA AAGTGTAAAGCATTCCAACAAAGGGTTTTAATGTAGATTTTTTTTTTGCACCCCATGTGT TGATTGCTAAATGTAACAGTCTGATCGTGACGCTGAATAAATGTCTTTTTTTTAATGTGCTG TGTAAAGTTAGTCTACTCTTAAGCCATCTTGGTAAATTTCCCCAACAGTGTGAAGTTAGAAT TCCTTCAGGGTGATGCCAGGTTCTATTTGGAATTTATATACAACCTGCTTGGGTGGAGAAGC CATTGTCTTCGGAAACCTTGGTGTAGTTGAACTGATAGTTACTGTTGTGACCTGAAGTTCAC CATTAAAAGGGATTACCCAAGCAAAATCATGGAATGGTTATAAAAGTGATTGTTGGCACATC CTATGCAATATATCTAAATTGAATAATGGTACCAGATAAAATTATAGATGGGAATGAAGCTT GTGTATCCATTATCATGT | SEQ ID NO: 830 |
| RPL10A | 200036_s_at | CAGCTTGAAGAACTATGATCCCCAGAAGGACAAGCGCTTCTCGGGCACCGTCAGGCTTAAGT CCACTCCCCGCCCTAAGTTCTCTGTGTGTGTCCTGGGGGACCAGCAGCACTGTGACGAGGCT AAGGCCGTGGATATCCCCCACATGGACATCGAGGCGCTGAAAAAACTCAACAAGAATAAAA ACTGGTCAAGAAGCTGGTCAAGAAGATGATGCGTTTTTGGCCTCAGAGTCTCTGATCAAGC AGATTCCACGAATCCTCGGCCCAGGTTTAAATAAGGCAGGAAAGTTCCCTTCCCTGCTCACA CACAACGAAAACAT | SEQ ID NO: 831 |
| RNPS1 | 200060_s_at | CAGGGAAAAGTGAGGCTCTTGGGGGTGGTTTGACCCTGCTTACCTGGGAGCACACTTTTCCC TTCCCCGATGACCTGGGATGGTGGCCAGGCCGTGCCCTTGCTGTTGCTGGGCAGTGTCCTTT TGGAAAGGGAGCTGCCCCAGGCTTTAGTGCAGCTGCCAACCCTGTTAGGCCTGGCCTCTCGA GGCCTCTTCTGATCTCAAGGGTCACACCCCCTCAAAGATCCTCTCACCCATGGTAGTTGCTG CTCGTGGTTCTGTCTGTCCGTGCACCGATGCACACACCGCACCCCACCACTGTACTCTGAAA TTGGCGAGTGAGTGGAGAGCCAGCTCTGCGGAGTCATCACGCAGCCATGGTTGTGCCTGCCG TTCATGTGGTCTTTCAGGTTATCTTGGCAACATGTACATTGCTTTTATTTTTTTCTTTTT TGCTTTCATTGTACAGTCAGTACTATAAAATTTCTCTTTTGAGTTTTATACCTTTGTAGCAT TTTAGATGACATTGTGTTTGTACTTTGTTG | SEQ ID NO: 832 |
| RPS6 | 200081_s_at | ACTTCGTACTTTCTATGAGAAGCGTATGGCCACAGAAGTTGCTGCTGACGCTCTGGGTGAAG AATGGAAGGGTTATGTGGTCCGAATCAGTGGTGGGAACGACAAACAAGGTTTCCCCATGAAG CAGGGTGTCTTGACCCATGGCCGTGTCCGCCTGCTACTGAGTAAGGGGCATTCCTGTTACAG ACCAAGGAGAACTGGAGAAAGAAAGAGAAAATCAGTTCGTGGTTGCATTGTGGATGCAAATC TGAGCGTTCTCAACTTGGTTATTGTAAAAAAGGAGAGAAGGATATTCCTGGACTGACTGAT ACTACAGTGCCTCGCCGCCTGGGCCCCAAAAGAGCTAGCAGAATCCGCAAACTTTTCAATCT CTCTAAAGAAGATGATGTCCGCCAGTATGTTGTAAGAAAGCCCTTAAATAAAGAAGGTAAGA AACCTAGGACCAAAGCACCCAAGATTCAGCGTCTTGTT | SEQ ID NO: 834 |
| MDN1 | ADXCRAG_AB002299_at | CTGTTGTTGATGTAATTTGTGACTCTTCTTAATGGAAGATGACAGGATTGTAAAAGGTATGC TAGGGGACTGATCTTCTCTGCTGGATCAGTCAGTCAGCTGTTACTAGTTGATGCTGTGCTAA CATGATCCCCTCCTACTTCCATGTTGCTCTTACTACAAAGGTTATCATTTGCATTTATGTCC ATGGTAGGCTGAGCTATAATATGCTGGCTTTGCAGCAGAATGAAAAGGATGAGTTGGTGTAG CCTTATAAG | SEQ ID NO: 835 |
| MRPS2 | ADXCRAD_AL583494_s_at | TTGGCTGCAGTTAGGACCTCAGTGGCTGGTATGGCCGAGCTGCTAGAAGATGCTGCTGTCCC TGTGATCCCAGCAGCCCTCCCTTCACCGTGACCCCTGACCTTTGTCAGGAAGGTGCAGTTTT TCTTCTCAATCTAAATGCCTTTCAGGTGGGCCGCTTCCTTGGCTACCTGGTTCCAGGGGCT GTTTTGTAATGAGATGCTGCTGGCAGGCCACTCAGAGGCTCCCAGCTGGGTTGGTGGGACAG CCAGGCCAGATGACCTGATTCCAGCAAAAATAA | SEQ ID NO: 839 |
| ABCA7 | ADXCRAG_AB055390_s_at | CCCTGGCGCGCGTCTTTGGAGAGCTGGCGGTGCACGGCGCAGAGCACGGCGTGGAGGACTTT TCCGTGAGCCAGACGATGCTGGAGGAGTATTCTTGTACTTCTCCAAGGACCAGGGGAAGGA | SEQ ID NO: |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| | | CGAGGACACCGAAGAGCAGAAGGAGGCAGGAGTGGGAGTGGACCCCGCGCCAGGCCTGCAGC ACCCCAAACGCGTCAGCCAGTTCCTCGATGACCCTAGCACTGCCGAGACTGTGCTCTGA | 840 |
| ATP2A3 | ADXCRAG_AF068220_at | TGTCCCGGAACCACATGCACGAAATGAGCCAGAAGTGAGCGCTGGGAACAGAGTGGAGTCTC CGGTGTGTACCTCAGACTGATGGTGCCCATGTG | SEQ ID NO: 849 |
| ATP2A3 | ADXCRAD_BX437326_s_at | GACTGTGAGGTGTTCGAGTCACGCTTCCCCACCACCATGGCCTTGTCCGTGCTCGTGACCAT TGAAATGTGCAATGCCCTCAACAGCGTCTCGGAGAACCAGTCGCTGCTGCGGATGCCGCCCT GGATGAACCCCTGGCTGCTGGTGGCTGTGGCCATGTCCATGGCCCTGCACTTCCTCATCCTG CTCGTGCCGCCCCTGCCTCTCATTTTCCAGGTGACCCCACTGAGCGGGCGCCAGTGGGTGGT GGTGCTCCAGATATCTCTGCCTGT | SEQ ID NO: 850 |
| PDSS1 | ADXCRAD_BM824056_s_at | AACTTCGACCATCCCCAGAAAGAGATGCCCTCATTCAGCTTTCAGAAATTGTACTCACAAGA GATAAATGACAACTCTTTCTGTTCTTTCTGGCAGCTATCTTACCAGACTGTGCCTAAAGAAT TTTGTGGAATACACTTTGTTTGCTTCATGTGCAGATAACCAAAAATCATTTTAAAAGATATC AAACTTATTGATGGGCAAT | SEQ ID NO: 862 |
| CYFIP2 | ADXCRAG_AF132197_s_at | TGGGAATTTTTGTACAATGAATTTACATTTATTTATGGTGACATATTTACGCTTGTGATCAA ATAATGATGTTAAATTCTTAAATCATATTTGCTATGCAGCTGAAGATGATATTTTGA | SEQ ID NO: 863 |
| CYFIP2 | ADXCRAG_AF132197_x_at | TTTCAGAAACTGTCAAATGTACCATATTTGTATTAAGAGTTGTTGGGAATTTTTGTACAATG AATTTACATTTATTTATGGTGACATATTTACGCTTGTGATCAAATAATGATGTTAAATTCTT AAATCATATTTGCTATGCAGCTGAAGATGATATTTTGATTTGTATTTTGGGGGTACCTGTGT TGAGTTGATAAACATTTCCATCTTCATTAAAACTGCTTCCAAACTAAA | SEQ ID NO: 864 |
| BIN2 | ADXCRAG_AF146531_s_at | CTCAGGGAATATTTAATTCTGGTTTTAGCATTATTAGAATAAGACTTTATACATTAACTAAA GTGGAGCTTTAATCACTATAAAAGCAAAAGTATNTATAGACACAGACACTTGCCTATACAG AGACATAACCACACACACTCAGAGGATAGTGAACAAATCTGTCTTTGACTTACGACCCATTT TGCAAGAC | SEQ ID NO: 867 |
| MDN1 | ADXCRAG_AF503925_s_at | AGCAGGTGCCTGAACTCGTAACTAGAGAAGAGTTATCCTTCTTCCCTGCCTTGGAAGCCCTG GCCTGGGAGGAGGTCATACCCCACCGTTGGAGCCCAGCTGCCTGTTTTCTTTTGCAGGGGAT CTGGGCACCTGTGCCTTGAGGAGATGCTGCCAGGAGCATGGGACTCTGACAGTCCTTTGTAT AAAGGACTAAAGGGAGCTGCCCTTTTGACCCTGTTCTAAGCTCTGCCTTGCCAAGCCCATAG TGTGTGCCCAAAAGCTGTCAAGTGGCCAAGACAGCTCGTTTCTGGAG | SEQ ID NO: 879 |
| HSPD1 | ADXCRAG_AJ250915_at | TTTGTACATTCCTGATACTGGGTACAAGAGCCATGTACCAGTGTACTGCTTTCAACTTAAAT CACTGAGGCATTTTTACTACTATTCTGTTAAAATCAGGATTTTAGTGCTTGCCACCACCAGA TGAGAAGTTAAGCAGCCTTTCTGTGGAGAGTGAGAATAATTGTGTACAAAGTAGAGAAGTAT CCAATTATGTGACAACCTTTGTGTAA | SEQ ID NO: 881 |
| BCL11A | ADXCRAG_AJ404611_s_at | AAGCTGTTTGTCGTAACTTGAAATTTTATCTTTTACTATGGGAGTCACTATTTATTATTGCT TATGTGCCCTGTTCAAAACAGAGGCACTTAATTTGATCTTTTATTTTTCTTTGTTTTTATTT TTTTTTTTATTTAGATGACCAAAGGTCATTACAACCTGGCTTTTTATTGTATTTGTTTCTGG TCTTTGTTAAGTTCTATTGGAAAAACCACTGTCTGTGTTTTTTTGGCAGTTGTCTGCATTAA CCTGTTCAT | SEQ ID NO: 882 |
| BCL11A | ADXCRAG_AJ404613_s_at | CTTTCTGGCCCAGTTAATTTGCACAGAACTTTTCTCAGTTTGGTATTTTTTACTGCTTGGAG ATCCAGAAGAGAATTAGAAACAACATAGCAAATTAAAATAGGTTTGTCAATAATAGAGCTCA GACACCTGTGTGCTGTAGATTCACATACAGGCCGTGAACCTAAGTGGGGAAAATCCTACCTA TCCACCTTCTGGCTAGATTACCTAGCTTAGTGAAAAG | SEQ ID NO: 883 |
| BCL11B | ADXCRAG_AJ404614_s_at | TTATTATTGCTTGGTATTTGTGCTCTGTTTAAGAAACAGGCACTTTTTTTTATTATGGATAA AATGTTGAGATGACAGGAGGTCATTTCAATATGGCTTAGTAAAATATTTATTGTTCCTTTAT TCTCTGTACAAGATTTTGGGCCTCTTTTTTTCTTAATGTCACAATGTTGAGTTCAGCATGT GTCTGCCATTTCATTTGTACGCTTGTTCAAAACCAAGTTTGTTCTGGTTTCAAGTTATAAAA ATAAATTGGACATTTAACTTGATCTCC | SEQ ID NO: 884 |
| NUP210 | ADXCRAG_AK074101_s_at | ACGTGTGATCCCTTTCACTCCATCAGGACACCAGGACTGTCCTTAGGAAAATGTCCTTGAGA TGGCAGCAGGAGTCATATTTTCTGTGTGTGTTTCGGAAAGCCGCTGTGTCCTGCCTCAGC ACAAAGACCCAGTGTCATTTGCCTCCTGTTCCTGTGCCACTCCAGAACCTCAGCAGATCT GAGCCACCGCCTGCCAGTGTGAGAGGCGGCCACTTTCATGGCAGCT | SEQ ID NO: 885 |
| HMGB1 | ADXCRAG_AL110194_s_at | AAATCTATAATTAATTGGGCCAACTTTTAAAATGAAGATGCTTTTTAAAACTAATGAACTAA GATGTATAAATCTTAGTTTTTTGTATTTAAAGATAGGCATATGGCATATTGATTAACGAG TCAAATTTCCTAACTTTGCTGTGCAAAGGTTGAGAGCTATTGCTGATTAGTTACCACAGTTC TGATGATCGTCCCATCACAGTGTTGTTAATGTTTGCTG | SEQ ID NO: 888 |
| PAICS | ADXCRAG_AL833068_x_at | AATTAGCTGGGCGTGATGACAGGCACCTGTAATCTCAGCTACTCGGGAGGCTGAGACAGGAG AATTGCCTGAACCCGGGGGGTGGAGGTTGCAGTGAGCCAAGATCATGCCACTGCACTCCAGC CTGGGCAACAGAACGGAACTCTGTCTCAAATAAA | SEQ ID NO: 897 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| CHD7 | ADXCRAG_AL833190_at | CAGTTCAGCAAGCTAACATAATAATAAAAACAAGTTTTGCTGTCATTAAGTTTTATCATTGA GCTGTTAGGAGGGAAGAACTACTTAGGTATTTCCATTTGGAATGGCAGGTTCACCACAGAGG CTCACATTGAGATCAAGTTGTCTTCGACAGCCTTTATAGCCACTGTTTGCCTC | SEQ ID NO: 898 |
| 41888 | ADXCRAG_AY034177_s_at | ACACGTACACACATCCCTCACTTCTCTTAAGCCAAGAAGTTTGCTTTCCCTAGCTGCAGTGT AGATGGCTCTTGTTTTTGTTTTTTTGTTTTAATCATTTGGCATTCACATGTGGCTGTTAATA TGTGCTTGTTTTT | SEQ ID NO: 901 |
| USP7 | ADXCRAG_AY376241_s_at | CCCCAAAGAGGAGTCGCTACACTTACCTTGAAAAGGCCATTAAAATCCATAACTGATTTCCA AGCTGGTGTGTTCAAGGCGAGGACGGTGTGTGGGTGGCCCCTTAACAGCCTAGAACTTTGGT GCACGTGCCCTCTAGCCGAAGTCTTCAGCAAGAGGATTCGCTGCTGGTGTTAATTTTATTTT ATTGAGGCTGTTCAGTTTGGCTTCTCTGTATCTATTGACTGCCCTTTTTGAG | SEQ ID NO: 908 |
| TRIAP1 | ADXCRAD_BU539578_s_at | TTCAGAGCTCTCAGTGTGCAGTTCAGGAATTAAGATACTTGGAATAGCTGTGGAGGAAGAAC CTAAATTGCAAAGATCTGCTATTGCCAGCTCTCAACCCAAGTCAGTGAATTGTCAACCTGCA TATCCTAAAAATGTCAAAATGCTGCATCTGGTTAAATGTCGGGGTAGGGGGGAAGCTGAAGG TGCTCGCTTCATTTGCCTTGTTTACTCATCCTGCCCTGTAATGTCTGTAATCCTGAA | SEQ ID NO: 916 |
| RUVBL1 | ADXCRAD_CN389613_s_at | AAGAGCATGTCGAAGAGATCAGTGAACTTTTCTATGATGCCAAGTCCTCCGCCAAAATCCTG GCTGACCAGCAGGATAAGTACATGAAGTGAGATGGCTGAGGTTTTCAGCAGCAAGAGACTCC CCAGGTGTGCCTGGCCTGGGTCCAGCCTGTGGGCGCTTGCCCCTGGGCTTGGGGCTGCCGTC CCCACTCAGGCGTGGGCTGCAGCGCTGTCAGTTCAGTGTGGAAAGCATTTCTTTTTAAGTTA TCGTAACTGTTCCTGTGGTTGCTTTGAAAGAACCCTTC | SEQ ID NO: 918 |
| IMPDH2 | ADXCRAG_BC006124_at | AGTGTCTGGTGCTGTGCAGGACAAAGGGTCAATCCACAAATTTGTCCCTTACCTGATTGCTG GCATCCAACACTCATGCCAGGACATTGGTGCCAAGAGCTTGACCCAAGTCCGAGCCATGATG TACTCTGGGGAGCTTAAGTTTGAGAAGAGAACGTCCTCAGCCCAGGTGGAAGGTGGCGTTCA TAGCCTCCATTCGTATGAGAAGCGGCTTTTCTGAAAAGGGATCCAGCACACCTCCT | SEQ ID NO: 921 |
| TRIM14 | ADXCRAG_NM_033219_s_at | TGGACTACGAGGCCGGCGTCCTCGCCTTCTACGACGTGACGGGCGGCATGAGCCACCTGCAT ACCTTCCGCGCCACGTTCCAGGAGCCGCTCTACCCGGCCCTGCGGCTCTGGGAGGGGGCCAT CAGCATCCCCCGGCTGCCCTAGGGGCCAGGACCGGCGTGACAGCCTCCAGA | SEQ ID NO: 922 |
| LCP1 | ADXCRAG_BC007673_s_at | TGTAATGGAACTTAGCCATTTTTCAAAGCAATTGAAATGCATTGCTCTGGATCTGTTCCTTG GCAGTGGACTCAGAAAGCCAACATGTGGCTCCTCCCAGCCCATAACCAGTATTTTTGCTGCT TCTGAATACAAATTGGTTGGTTTTGACTTCAGATTGAACTTACTGTAGCCTCAGATGATTTC CCCCCTCCGCCTCCAGGAAGAAAGAATGTTACTGCCTTAATAAA | SEQ ID NO: 924 |
| EZH2 | ADXCRAG_BC010858_s_at | AAATGGAAATCCCTTGACATCTGCTACCTCCTCCCCCCTCCTCTGAAACAGCTGCCTTAGCT TCAGGAACCTCGAGTACTGTGGGCAATTTAGAAAAAGAACATGCAGTTTGAAATTCTGAATT TGCAAAGTACTGTAAGAATAATTTATAGTAATGAGTTTAAAAATCAACTTTTTATTGCCTTC TCACCAGCTGCAAAGTGTTTTGTACCAGTGAATTTTTGCAATAATG | SEQ ID NO: 929 |
| CYFIP2 | ADXCRAG_BC011762_s_at | AGACAGACAGTTCCACTGTGGAGCATGTGCGCTGCTTCCAGCCACCCATCCACCAGTCCTTG GCCACCACTTGCTAAGCAGAAGATCCTGCAGACCCTTATCTGGAGGAGGAAGAGAAGCAGGA GAGAGAAAGCCACAGCCAGCCTGCCATAGGATCCAACTGGACAACGTGTGGGATGGACCTGG AAACAAGCACCTCCCCAAACACATCACCACTCCCTAGGGCGGGGCCTGTGCATGCTCTCCCA TGACATCTCCATGCTGGTTTCTCCATAGCATAAATG | SEQ ID NO: 932 |
| PCCB | ADXCRAG_BC017735_at | GTACAATTTGAAACTGATGCTTCACCTTTCCTTTAA | SEQ ID NO: 941 |
| PCCB | ADXCRAD_CB163512_s_at | TTTCTCCCAGAATTGTGGGCTTCACTGGAAGTGAAGGTGCAGGAATGACTGGACTGTCCACC CCAGCCCTGCCTGCCTGTGGTTTTGGCCAGGGAGCAAGCCATGAGGTGCCCTGGCACATGCA CAAATTGATCCTTTGCGTGACAGTCTTGTATGGAAAACAGATGCTGACAGAATTGTAGACTA CCATGCCACACAAAAAGGCTAAATATCTACTCCAATGGGTTTCCAGTTCAGTTTGAAGTCAA TCAAATTTTTGTATTTTTCGGTGTCTCCTTGATTGGTTTTGCTA | SEQ ID NO: 942 |
| PCCB | ADXCRAG_BC018013_at | CTCGAGTTAGTTTTTTTATCCATAGGTGAGATATATAGTAAGTTTTTAAGGCAAAGTATTTC TTAGGCTTAAGTTTCCTTATTTTAAAAATAGGGTAATATGCCCTATCTATCTCCTAATTCCT CCATGAATTGAGGATTAAATGTGATGTTTGCAATTGTGGTATATGTGTTTAGCAGTACAGAT GCTCAATAAGGCATAGCACCCTATGTTGACTCAGGTTATTTCCAGAA | SEQ ID NO: 944 |
| IKZF1 | ADXCRAG_BC018349_s_at | GGGTTCTTAGTCTCAGCACTATGACATTTTGGGCTGACTACTTATTTGTTAGGCAGGAGCTC TCCTGTGCATTGTAGGATAATTAGCAGTATCCCTGGTGGCTACCCAATAGCGCCAGTAGCA CCCCGAATTGACAACCCAAACTCTCCAGACATCACCAACTGTCCCCTGCGAGGAGAAATCAC TCCTGGGGGAGAACCACTGACCCAAATGAATT | SEQ ID NO: 945 |
| BCL11A | ADXCRPDRC.960.C1_s_at | CATTCGGCGTAGTACCCAGAGAGCTCAAGATGTGTGGCAGTTTTCGGATGGAAGCTCGAGAG CCCTTAAGTTCTGAGAAAATTTGAAGCCCCCAGGGGTGGGTGGACGGTGCCGCCCAGTCGA CGTCAGCGTGGTCTGTCATCCTGCTAGTTTGTGATGTTTTCTGACAGTAGCCTCCAAGAAGC CGTTGTGCGAAGACAGAGTCCTGCAGAGTCCTTCCAGCCTAGGCCTGCAGCGCCATTTA | SEQ ID NO: 947 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| CD3D | ADXCRAG_BC039035_at | AAAAATAGATGTTGGGTCTCGTCAAGTGCTTACCCTGCATCCATTGAGATGATAATATGGTT TTACTTTTTTAGTCTGTTAATATGGTACATTACATTGATGGCACGATATGTTAAACCAACCT | SEQ ID NO: 959 |
| CD3D | ADXCRAG_BC039035_x_at | AGTTCTTTTCTTTCTAGTTTGCTGAGAATTTTTATCAAAAATAGATGTTGGGTCTCGTCAAG TGCTTACCCTGCATCCATTGAGATGATAATATGGTTTTACTTTTTTAGTCTGTTAATATGGT ACATTACATTGATGGCACGATATGTTAAACCAACCTTTCATTCCTGAAAAAAACTCTAGTCA TTTGGTATTATTCT | SEQ ID NO: 960 |
| RNF44 | ADXCRAG_BC039833_at | AATATTGTTGCTGATTTCAGAGGGATATTCACTAATAAATGTAT | SEQ ID NO: 962 |
| RNF44 | ADXCRAG_BC039833_s_at | TTTCCATTCCATGGGATTCACATTGGTTTGTAGCATTTAACATAACTAGTATGTTGTATTAT ATATATGTGTATACTGTGATTGAAATTTTTAACAGATTTGTACTTTTTTTAAAATGAAAGTTGC TAGTTCTGCTTGACCAAGTAGTG | SEQ ID NO: 963 |
| SKAP1 | ADXCRAD_CR741870_s_at | CCAAGTCTCTTGACACCTCAGAGTGACTGTAAGCTACCAGTAAGACAAGTGGGAAGAGGCAC GTTCATCAAACCTGTTACTAAACCAGCCTAGTCATAGCTCATCCCCATCTCTAAATGTGTCC ACACAACCACATCTGCCTTTTCCACAAGCTTTTCACAAAGAAGGTGAGAGAGAAGGAAACCT TGGGAGGAGGACATTACTGGTTGTTCTGGCTGGTTTGAA | SEQ ID NO: 969 |
| NASP | ADXCRAD_CX783596_s_at | GATATTTCCCACCTTGTCAGAAAGAAGAGGAAACCAGAGGAAGAGAGTCCCCGGAAAGATGA TGCAAAGAAAGCCAAACAAGAGCCGGAGGTGAACGGAGGCAGTGGGGATGCTGTCCCCAGTG GAAATGAAGTTTCGGAAAACATGGAGGAGGAGGCTGAGAATCAGGCTGAAAGCCGGGCAGCA GTGGAGGGGACAGTGGAGGCTGGAGCTACAGTTGAAAGCACTGCATGTTAA | SEQ ID NO: 972 |
| NUP210 | ADXCRAG_BC067089_s_at | GTGTCGCCATGGTAAGCTTGGGCCATCGGTCCCCACTGTTGGTTTTCATTCCTTATCTGGGC TGTTGTGTGGTTAATTGATTGATCATTTTGAAAGCTAGCACTTGACTCACACTCGGAATCCC AGAA | SEQ ID NO: 976 |
| HNRNPA2B1 | ADXCRAG_BX537494_s_at | GAATGTGATACTCAGGGCTTACTCTATACACCAATGAGTCTTCTTTGATCCTAAGACCACCA CTGAAGTTGTTTAGGTTCTTTTGGACAAACATGATAAACTTCTTCAGA | SEQ ID NO: 978 |
| PAICS | ADXCRAG_BX538303_at | TAGGCACAAAATTTAATTCTCAGAGCCTATAAAAACAGTAAAGGAAATAGGCATGAACACAC AAGGCCAGATAACAGCAGTAACATTTTGGCAACTGAAAGGCAAACACAGTGGTAGCTAAGTT AGCAGACCAAGAAAACTTAATC | SEQ ID NO: 980 |
| PAICS | ADXCRAG_BX538303_x_at | TAGGCACAAAATTTAATTCTCAGAGCCTATAAAAACAGTAAAGGAAATAGGCATGAACACAC AAGGCCAGATAACAGCAGTAACATTTTGGCAACTGAAAGGCAAACACAGTGGTAGCTAAGTT AGCAGACCAAGAAAACTTAATCAAAATTAGCTGGCATGG | SEQ ID NO: 981 |
| THUMPD1 | ADXCRAG_BX640898_at | TGCAGTCTTATGGTTTAGAAAACTTGTTTAGCTCCATAGAGGAAAGAATGTTAAACTTTGTA TTTTAAAACATGATTCTCTGAGGTTAAACTTGGTTTTCAAATGTTATTTTTACTTGTATTTT GCTTTTGGTACGGCCAGAAATCGAGCTTGTTTTTTCATAGTTCCTGATATTTTCAGAA | SEQ ID NO: 982 |
| TRAF3IP3 | ADXCRAD_NM_025228_s_at | CCTCCCAGAAGGCAATGTGGGCGATGGCTCCCAGTGCTGATGGTGGTGATTGCTGCAGCACT GGCAGTGTTCCTGGCCAATAAAGACAACCTGATGATCTGAATAATTTGTGACAACTGCCTTG GGTGAAAATCAGAAGCAAGCAACTCAGCGAAAAACTCAGAAGGTTTGGGTACATTACAGCTT GGGTTTTCCAACTGACTTAGGATTTCTGACTTTTATTAATTTCTTAACCTACTGTAAATAA ACTTCACCTGACCAGATTGTTCCT | SEQ ID NO: 985 |
| HNRNPA2B1 | ADXCRAG_D28877_s_at | TCTTTGTAAGAGTGTAGAAGCATTCCTTCTTTGATAATGTTAAATTTGTAAGTTTCAGGTGA CATGTGAAACCTTTTTTAAGATTTTTCTCAAAGTTTTGAAAAGCTATTAGCCAGGATCATGG TGTAATAAGACATAACGTTTTTCCTTTAAAAAAATTTAAGTGCGTGTGTAGAGTTAAGAAGC TGTTGTACATT | SEQ ID NO: 987 |
| MX2 | ADXCRAD_AJ711736_s_at | AAATTCTTCTTTTGTATGTCCAGTCTCCTGCACAGCACCTGCAGCATTGTAACTGCTTAATA AATGACATCTCACTGAACGAATGAGTGCTGTGTAAGTGATGGAGATACCTGAGGCTATTGCT CAAGCCCAGTCCTTGGACATTTAGTGCTTAGCCGGTCCCTTTCAGATCCAGTGGCCATG CCCCCTGCTTCCCATGGTTCACTGTCATTGTGTTTCCCAGCCTCTCCACTCCCCCGCCAGAA AGGAGCCTGAGTGATTCTCTTTTCTTCTTGTTTCCCTGATTATGATGA | SEQ ID NO: 995 |
| ITGB7 | ADXCRAG_M68892_s_at | CTTCTCCTTGGAGGACAGTGGGAACTGGAGGGTGAGAGGAAGGGTGGGTCTGTAAGACCTTG GTAGGGGACTAATTCACTGGCGAGGTGCGGCCACCACCCTACTTCATTTTCAGAGTGACACC CAAGAGGGCTGCTTCCCATGCCTGCAACCTTGCATCCATCTGGGCTACCCCACCCAAGTATA CAATAAAGTCTTACCTCAG | SEQ ID NO: 997 |
| ADA | ADXCRAD_CB158570_s_at | GGGCAGAACCTCTGAAGACGCCACTCCTCCAAGCCTTCACCCTGTGGAGTCACCCCAACTCT GTGGGGCTGAGCAACATTTTTACATTTATTCCTTCCAAGAAGACCATGATCTCAATAGTCAG TTACTGATGCTCCTGAACCCTATGTGTCCATTTCTGCACACACGTATACCTCGGCATGGCCG CGTCACTTCTCTGATTATGTGCCCTGGCCAGGGACCAGCGCCCTTGCACATGGGCATGGTTG AATCTGAAACCCTCCTTCTGTGGCAACTTGTACTGAA | SEQ ID NO: 1001 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| CD1C | ADXCRAG_NM_001765_s_at | ATTGCCTTGGTAGTGATAGTGCCCTTGGTGATTCTAATAGTCCTTGTGTTATGGTTTAAGAA GCACTGCTCATATCAGGACATCCTGTGAGACTCTTCCCCCTGACTCCCCATTGTGTTAAGA ACCCAGCAACCCAGGAGCCTAGTACAATATAGTGATGCCATCCCGTCGACTCTCCATTTAAA TTGTTTCTCTTTCTGCATAATAAA | SEQ ID NO: 1012 |
| PTPN7 | ADXCRAG_NM_002832_s_at | GGAGGAGCTGCTCCTTCCTTACAGCCTTGGGGATGGACTTGCCCACACCTCCACCTCCCCTG AGCCCTGTGAGAGGCACGACTGTCTATGCCAATGAGGCTCGGTGGGGGGCTCTCAAGTGCCT GATCCTGCCCTGGGCTCAGAGCCAGCCCAGAGGGAAGCAACTGCACAGCCCCACAGGCCCTC CCTGGCACTGTCCCCCCAACCCCATCTCAGAGCTCAGAGGGTACAAGCTCCAGAACAGTAA | SEQ ID NO: 1019 |
| LCP2 | ADXCRAD_BP306313_s_at | CAGATATTATTGACTACTTCAGGAAAATGCCACTTCTGCTCATTGATGGGAAAAACCGAGGT TCCAGATACCAGTGCACATTAACGCATGCTGCAGGGTACCCATAGCAAGTTATAGCCGAGCA AATGAACCGTCCTCCTGCCTCTGTTGCCAACACGAGATCAATCAGCCTTGGTCAATGGACAA ACACTTAGGACTGAACTGAACCCCTC | SEQ ID NO: 1030 |
| IQGAP2 | ADXCRAG_NM_006633_s_at | CAACACAATAACACTTTCTGTATAAAAGTATATATTTTATGTGATTTATTCCTACTAAATGA AAGTGCACTACTGCCTCATGTAAAGACTCTTGCACGCAGAGCCTTTAAGTGACTAAGGAACA ACATAGATAGTGAGCATAGTCCCCACCTCCACCCCTCACAATTTATTTGAATACTTCAATTG TGCCTCTCAATTTTTT | SEQ ID NO: 1037 |
| TTF1 | ADXCRAG_NM_007344_at | ATCGCACCACCGCATGAGAGAGAGAGATTACTATTTCTTGTCCCTTTTTCTCAGTTTGATTA TATTTATATACATATGTCAGTAAATCTGTTTTCAGTATTGATGTTTAATAAAGAATGTACAA TGGCCAGAGTTCTACTCTTTCCTCTGGAGCATTAAAATATATTGCCATTCCTATTAAAACGT ATTTG | SEQ ID NO: 1038 |
| CALML4 | ADXCRAG_NM_033429_s_at | TACAAACTGACATTGTCTACTATACATTTTTAAAAGCCATTTTACTGGTTTGGCATGCGGTA TGGAAATTCTAAGAGAAAGTTTTAAGGCAATGAATCACAGATTTAAGTTCATGGAATTTA TGGTAACTTTATCTGTTTATGTACATTTTCCCCTTTGTTAAACAATTAACAGCAGCACACTC TGGGACCACCAGCTATTTTCCCTCTCTTTCTGAAATCTAAGCTTTGT | SEQ ID NO: 1048 |
| NFATC3 | ADXCRAG_NM_173164_x_at | CAGGTACCACGGCTCACGCCTGTATCCCAGCACTTTGGAAGGCTGAGGCGGGTGGATCACAA GGTCAGGAGTTCAAGACCAGCCTGGCCAACATGGTGTAACGCTGTCTCTACTAAAAATACAA AAAATTAGCCAGGCATGGTGGTGTGTGACTATAATCCCAGCTACTCGGGAGGCTGAGACAGG AGAATCACTTGAACCCGGGAGGTGGCAGTTGCAGGGAGCTAAGATCGCGCC | SEQ ID NO: 1052 |
| TMPO | ADXCRAD_CN272683_s_at | CTAGCTATAAGGCTATAATTGGAAATTTGTATTTTTTATTTACAGCAAAACATTTATTCAGT CATCCAGTTTGCTACCAAAATATGTTTTAGATAAGTGTGTGTATGTTTGTTTAGAAGTTAGA AATTGTAAACACTGGTCTTATGTTTCATTTGGATTCATTATTGCATTGTCTTGTTACCAGAA ACAAATTTTGCCGAGCTTTTTTGCCCTATATTTCCCAGCATAATTTGATTAGAAAGT | SEQ ID NO: 1061 |
| SLC19A1 | ADXCRAG_U17566_s_at | GAAGTACGTCCCAGCGGCCTCAGGGTCTAAGGAGCGCTAGTGCCTTGCCCACAGGTGCGGGA CCATCTGATGTGATGTGAATACTCTTCCCACATACATTAAACACACTTA | SEQ ID NO: 1064 |
| MYB | ADXCRAG_U22376_x_at | GGGAATTCGTTCACAAATGTACTGATACCACAGATGTGGGCAGGGGCTAGGAGAGCAACAGG GTGCAGCCTGAAGGCACCTGGAAGGCCGCCTGGAGGGGGACAGTCAGGAAAGCAGGAGCCCT TGAGAGGAGCACTAGCCTTTGATGAGACCACTGCCATCGAAGGAGACCTCACAGGGAGGGAG CCAAGGGTAAACCCTAACTTTGTTTCCCCATTTCTCCTATCTCTGCCTAGGGGTCCTCACTG GCAGAACCAACCAG | SEQ ID NO: 1065 |
| BLM | ADXCRAG_U39817_s_at | GGGTCTGCCACACATGTAGAAAGATATCTTCCAAAACGAAATCCTCCAGCATCATTGGATCCAG TTCAGCCTCACATACTTCTCAAGCGACATCAGGAGCCAATAGCAAATTGGGGATTATGGCTC CACCGAAGCCTATAAATAGACCGTTTCTTAAGCCTTCATATGCATTCTCATAACAACCGAAT CTCAATGTACATAGACCCTCTTTCTTGTTTGTCAGCATCTGACCATCTGTGACTATAA | SEQ ID NO: 1067 |
| HMGB1 | ADXCRAG_U51677_x_at | ATGATGAATAAGTTGGTTCTAGCGCAGTTTTTTTTTTCTTGTCTATAAAGCATTTAACCCCC CTGTACACAACTCACTCCTTTTAAAGAAAAAAATTGAAATGTAAGGCTGTGTAAGATTTGTT TTTAAACTGTACAGTGTCTTTTTTTGTATAGTTAACACACTACCGAATGTGTCTTTAGATAG CCCTGTCCTGGTGGTATTTTCAATAGCCACTAACCTTGCCTG | SEQ ID NO: 1068 |
| MAP4K1 | ADXCRAD_BG397984_s_at | TTCTGGAAGCATGGAGTGCAGGTGTGGGCTCTAGGCTCGGATCAGCTGCTACAGGAGCTGAG AGACCCTACCCTCACTTTCCGTCTGCTTGGCTCCCCAGGCCTGTAGTGGTGGAGACACGCC CAGTGGATGATCCTACTGCTCCCAGCAACCTCTACATCCAGGAATGAGTCCCTAGGGGGGTG TCAGGAACTAGTCCTTGCACCCCCTCCCCCATAGACACACTAGTGGTCATGGCATGTCCTCA TCTCCCAATAAACATGACTTTAGCCTCTGCAAAA | SEQ ID NO: 1070 |
| GCN1L1 | ADXCRAG_U88837_s_at | TGATACTGCCCACCATACAGAAGTCCTTACTGAGGAGTCCAGAGAATGTTATTGAAACTATT TCTAGTCTGCTGGCATCAGTGACGCTTGACCTCAGCCAGTATGCCATGGACATCGTGAAAGG ACTGGCTGGTCACCTGAAATCAACAGTCCCGCCTGATGGATGAAGCTGTGCTGGCACTGC GGAACCTGGCACGCCAGTGCAGTGACTCTTCGGCCATGGAGTCCCTGACCAAGCACCTATTT GCTATCCTCGGAGGCTCGGAAGGAAAACTAACTGTTGTAGCCCAGAA | SEQ ID NO: 1077 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| ATP5D | ADXCRAG_X63423_at | GCCCTGGAGTAGGCGAGCCAGCCGCCAAGGTTGACC | SEQ ID NO: 1080 |
| ATP5D | ADXCRAD_CV025452_s_at | CCACCTCCAAATACTTTGTGAGCAGCGGTTCCATCGCAGTGAACGCCGACTCTTCGGTGCAG TTGTTGGCCGAAGAGGCCGTGACGCTGGACATGTTGGACCTGGGGGCAGCCAAGGCAAACTT GGAGAAGGCCCAGGCGGAGCTGGTGGGGACAGCTGACGAGGCCACGCGGGCAGAGATCCAGA TCCGAATCGAGGCCAACGAGGC | SEQ ID NO: 1081 |
| ATP5G2 | ADXCRAG_X69908_at | TAAGATGTTTCTTGAGTCTCCTGTGTATATTTCTTTTCCACAGTTGGCTGAGTGCCTTCGTG AGAGTACAAGGCCCGAAGGGTAGTGATGGTGCTAAACTCAACATGGATTTGGCTGAGCTC | SEQ ID NO: 1083 |
| GCN1L1 | ADXCRAG_XM_0457920_at | TAAAGGCTTTGATTTAATCTTGATATAAACAGATTTTTAAAAATCTCCACCCATTAAACATG AAGCTTCCTGCATCAGGAA | SEQ ID NO: 1085 |
| GCN1L1 | ADXCRAD_BU599568_s_at | TCTTCTCCTGTGCTTGAGCTCTGGTTTGAGAGCTGGCGCTACCAACCTTTTTCCTATATCCC GAGTGGGGCACAGACGGTGGATCTCTGCCCAGTGTGGTGTGTCTCGGCTTGGCTTTTCAATAT TGTGAGGTCTGAATGGATCTGATCCCTGTCAGATGAAAATGATTCACAGCTCTGGCAGTTCC CAAGTCTGGGGAGGGGTATAGGTTTGAAAGGCTGTTTGAA | SEQ ID NO: 1086 |
| CHD7 | ADXCRAG_XM_0987621_at | TTTAATAAAAGTGACCCATGATATGCAGAGATGTAA | SEQ ID NO: 1087 |
| CHD7 | ADXCRAD_BU675017_s_at | GGTCTTGTAATGCACTGGTAAAAACAAAATAAATAGATGAATAAATAAAGAGTGAGAGAAGA GAGAATCAGGTACCTTTTTTAAATTAAAGGACTTTGTTACTTTAGCCACAAAGCTAAAACAG CATTACCTCAGCTCTAAACTAGCCTTGAAGTTTACAGACATGACTTTGTAAATGTATTGTTT TTCTTTGTTGTGATGTCCTTTTATTT | SEQ ID NO: 1088 |
| CHD7 | ADXCRAD_BU538327_s_at | AACAGCCATCTTTTCAGCAGTTGCCAACCTGTCCTCCACTGCAGCCTCACCCGGGCTTGCAC CACCAGTCTTCACCTCCACACCCTCATCACCAGCCTTGGGCACAGCTCCACCCATCACCCCA GAACACCCCGCAGAAAGTGCCTGTGCATCAGCATTCCCCGTCGGAGCCCTTTCTAGAGAAAC CAGCGCCGGATATGACTCACGTTAGTGGACCGAATGCTCAGCTAGTGAAGAGTGATGATTAC CTGCCATCAATAGAACAGCAGCCACAAC | SEQ ID NO: 1089 |
| TMEM176B | ADXCRAG_XM_377999_s_at | TACAAGCCTCTATGTAAAGCACAGGCTGGTGAGGGCCCCAGGAAGAGCAGCACCGCCCTCGG CACAGGCCCCTACTCCAAGTCCTGTGCAGGAGCAGGTCTTGCCCAGCGCAGCAGCTCTGCAC CTCTGTGGCACCGCTCTGCCAAGAGGGAAGGTGCAGGCCCTGCAGCCCATCGCCTTGGATCT GAAGACCAGCCCTGTGGGGCTGCTAAGTCATGAAACTGGCCTCATGGAGATTTCATAA | SEQ ID NO: 1093 |
| GLTSCR2 | ADXCRIH.292.C1_s_at | TGATCGAGCCTCGAGAGAGAGCCAAGTTCAAACGCAAGTACTAGGTGAAGCTGGGTGGAGAA GCGGGCGTTCCGTGAGATCCAGTTGTAGCTGCCATCAGATGCC | SEQ ID NO: 1102 |
| MYC | ADXCRIH.2640.C1_s_at | TGATCAAATGCAACCTCACAACCTTGGCTGAGTCTTGAGACTGAAAGATTTAGCCATAATGT AAACTGCCTCAAATTGGACTTTGG | SEQ ID NO: 1105 |
| TOP1 | ADXCRIH.2689.C1_x_at | CTTGATTTTAAAGATCGTGTAGATTGGGGTTGGGGAGGGATGAAGGGCGAGTGAATTTAAGG ATAATGAAATAATCAGTGACTGAAACCATTTTCCCATCATCCTTTGTTTTGAGCATTCGCTG TACCCTTTAAGATATCCATCTTTTTCTTTTTTAACCCTAATCTTTCACTTGAAAGATTTTATT GTATAAAAAGTTTCACAGGTCAATAAAATTAG | SEQ ID NO: 1110 |
| PSMB10 | ADXCRIH.3674.C1_at | TCGCGGCCCGTAGATAACGCGTGTAGCTCCATCTTGGACGCCACCATCCGTGTGGTCATCTC GGCGTCCGCGGCTACTCCAGCCCCACAGCAGTAGATTTTGGGGGCGATGAAGTGGATCTTCT CGCAGCTCTTGTCCGCCACGACCGAATCGTTAGTGGCTCGCGTATCGGCGCCCAGAATGACC CCCGTCTTGGAACACCAAGCCCGCGATGGTGGTCCCGGTCTTGCGTGCGTGAAGGGACCTTG AGCCCCGGGAGGACGCGTTCCAATGATGCATTTT | SEQ ID NO: 1114 |
| CNBP | ADXCRIH.383.C1_s_at | GGAAAGAGCAACTGAAGTCCTAGAAAATAGAAATGT | SEQ ID NO: 1131 |
| ANP32B | ADXCRIH.2787.C1_s_at | ACATTCCGCCTTCCTTCCATGTAGTCCCTCTTGGTAATCTACCACCAAGCTTGTGGACTTCA CTCCAACAAAATTGTAAGCGTTGTTAGGTTTTGTGTAAGATTCTTGCTGTAGCGTGGATAG CTGTGATTGGTGAGTCAACCGTCTGTGGCTACCAGTTACACTGAGATTGTAACAGCATTTTT ACTTTCT | SEQ ID NO: 1143 |
| MRPL16 | ADXCRIH.2001.C1_s_at | ACATGCTGGGCATACGGAAAGTACTGAGCCCATATGACTTGACCCACAAGGGGAAATACTGG GGCAAGTTCTACATGCCCAAACGTGTGTAGTGAGTGTAGGAGATAACTGTATATAGGCTACT GAAAGAAGGATTCTGCATTTCTATTCCCCTCAGCCTACCCACTGAAGTCTTTGGGTAGCTCT TAAGCCCATAACTAAGGAGCAGCATTTGAGTAGATTTCTGAAA | SEQ ID NO: 1144 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| TUFM | ADXCRIH.1094.C1_s_at | TAGAGAAAGGCCAGCGTTTCACCCTGCGAGATGGCAACCGGACTATTGGCACCGGTCTAGTC ACCAACACGCTGGCCATGACTGAGGAGGAGAAGAATATCAAATGGGGTTGAGTGTGCAGATC TCTGCTCAGCTTCCCTTGCGTTTAAGGCCTGCCCTAGCCAGGGCTCCCTCCTGCTTCCAGTA CCCTCTCATGGCATAGGCTGCAACCCAGCAGAGGGCAGCTAGATGGACATTTCCCCTGCTCG GAAGGG | SEQ ID NO: 1146 |
| PIM2 | ADXCRIH.2055.C1_s_at | AGTGGATCTCTCGACACCAGTACCATGCACTCCCGGCCACTGTCTGGTCACTGGGCATCCTC CTCTATGACATGGTGTGTGGGGACATTCCCTTTGAGAGGGACCAGGAGATTCTGGAAGCTGA GCTCCACTTCCCAGCCCATGTCTCCCCAGACTGCTGTGCCCTAATCCGCCGGTGCCTGGCCC CCAAACCTTCTTCCCGACCCTCACTGGAAGAGATCCTGCTGGACCCCTGGATGCAAACACCA GCCGAGGATGTACCCCT | SEQ ID NO: 1149 |
| PFDN5 | ADXCRIH.3098.C1_s_at | GATAGATTTTCTAACCAAGCAGATGGAGAAAATCCAACCAGCTCTTCAGGAGAAGCACGCCA TGAAACAGGCCGTCATGGAAATGATGAGTCAGAAGATTCAGCAGCTCACAGCCCTGGGGGCA GCTCAGGCTACTGCTAAGGCCTGAGAGTTTTTGCAGAAATGGGGCAGAGGGACACCCTTTGG GCGTGGCTTCCTGGTGATGGGAAGGGTCTTGTGTTTTAATGCCAATAAATGTGCCAGCTGGG C | SEQ ID NO: 1158 |
| RPL3 | ADXCRIH.445.CB1_s_at | CCTTGCTGGTGCAGACGAAGCGGCGGGCTCTGGAGAAGATTGACCTTAAGTTCATTGACACC ACCTCCAAGTTTGGCCATGGCCGCTTCCAGACCATGGAGGAGAAGAAAGCATTCATGGGACC ACTGAAGAAAGACCGAATTGCAAAGGAAGAAGGAGCTTAATGCCAGGAACAGATTTTGCAGT TGGTGGGGTCTCAATAA | SEQ ID NO: 1162 |
| MSH2 | ADXCRIH.1841.C1_at | AAATGGCTGGTCGTACATATGGAACAGGTGCTCCATTTGACACGTGAGCAAAGCTGACAACA GCATCTAGCTGAGCTAACACATCATTGAGTGTCTGCATTGGTTCTACATAGCCTGAAGAAAT ATTGACAATTTCTTTAACAATGGCATCCTGGGCTTCTTCATATTCTGTTTTATTTTTGGTAT ACTCTTCATTTAAAGAAGTCAATTTGCTGTTGGTAAATTTAACACCATTCTTCTGGATATCT AC | SEQ ID NO: 1164 |
| TPT1 | ADXCRAD_NM_017627_s_at | GGGACTGATGTCATCTTGAGCTCTTCATTTATTTTGACTGTGATTTATTTGGAGTGGAGGCA TTGTTTTTA | SEQ ID NO: 1167 |
| TPT1 | ADXCRIH.18.CB1_x_at | ACTCATCAATTAACTTCTACAGTGGAGACTACTTCTGGGACTGGAATATAAAAAAGAATCAA AGGTTCTGATTTTGAGTTGCAATAAAGGGAAAGACCATGCTCATAGCAGTGCCAACATCTGA AGTGTGGAGCCTTACCCATTTCATCACCTACAACGGAAGTAGTTAACTGGAAGAGATTACCA AGAGAATAAAAAGAGACTCATTCAGTGGAACCAACCTCGTGCAGCCCGGG | SEQ ID NO: 1168 |
| SLC9A3R1 | ADXCRIH.2825.C1_s_at | TTTTGTTAAGAGTGCAGTATTGCAGAGTCTAGAGGAATTTTTGTTTCCTTGATTAACATGAT TTTCCTGGTTGTTACATCCAGGGCATGGCAGTGGCCTCAGCCTTAAACTTTTGTTCCTACTC CCACCCTCAGCGAACTGGGCAGCACGGGGAGGGTTTGGCTACCCCTGCCCATCCCTGAGCCA GGTACCACCATTGTAAGGAAACACTTTCAG | SEQ ID NO: 1169 |
| NDUFAB1 | ADXCRIH.1103.C1_s_at | TTGGGTTTGAAATTCCTGATATAGATGCTGAAAAGTTAATGTGTCCACAAGAAATTGTAGAT TACATTGCAGATAAGAAGGATGTATATGAATAAAGTATCAGACCCTTTGGCTTTGCTGAGAG AGGACTCAGATGATAGTGACGAATGTCTGGCAGTGAGGACACATTTTGGCATTCTTGCTGAC TCTGACAGAGTGATTCTGATGGACTTGTATTTAA | SEQ ID NO: 1172 |
| AKAP1 | ADXCRAD_NM_139275_s_at | TTCTATTTGTGCAAACTCTGTAAATATGTGTTTAAACAAATGTAATATTTTGTACAAGATAC ACTGGAGAACAAAGGGAACTCAAGATTCTTCCAGCCACATGTCACCTGTAGGTAGAAGTAAA CTCTGCAGTGCAGCTTCTGCTCTTGGCCCCTCTGGCCAGGGCCCTGTGGCTTCCTGCACAC TGGACAGGTGACTGTATGGTAGAGACTGTGATCTGGGAACTTTTTGCTGTACAAATCTGT | SEQ ID NO: 1173 |
| IL2RG | ADXCRIH.841.C1_at | GGGAATCTCACTGACGAGGCAGAGTCGTTCACTGTAGTCTGGCTGCAGACTCTCAGCCAGTC CCTTAGACACACCACTCCAGGCCGAAAAGTTCCCGTGGTATTCAGTAACAAGATCCTCTAAG TTCTTCAGGGTGGGAATTCGGGGCATCGTTCCGTTCCAGCCAGAAATACACACAGAGAAGGCT GATAATCAATCCCATGGAGCCAACAGAGATAACCACGCTTCCAATGCAAACAG | SEQ ID NO: 1179 |
| IMPDH2 | ADXCRIH.1164.C1_at | CACATTTTGGATTCCTCCATCAGCAATGACCGGAACACCAAAGCGCCGTGCATACTCTGACA CCTTGTACACTGCTGTTGCTTGGGGCCGCCCACAGGCCAGCACTTCCTGCGTAATGCAGATG GAGCCCACTTCCCATGCCCACCCGCAGGGCATCCACACCTGCATCAATGAGGTTCTTGGCCT GGGCAGCAGTGACCACATTGCCTCCAATGACTTGGAGATTAGGGTATTTGTCTTTGATGTAC TTGATCATATTGATCTGGAAGATGGAATTTCCCTGGG | SEQ ID NO: 1184 |
| MTHFD2 | ADXCRIH.873.C1_s_at | GCTGCAAAAAGGTGCTGAGGCTTGAAGAGCGAGAAGTGCTGAAGTCTAAAGAGCTTGGGGG TAGCCACTAATTAACTACTGTGTCTTCTGTGTCACAAACAGCACTCCAGGCCAGCTCAAGAA GCAAAGCAGGCCAATAGAAATGCAATATTTTTAATTTATTCTACTGAAATGGTTTAAATGAT GCCTTGTATTTATTGAAAGCTTAAATGGGTGGGTGTTTCTGCACATACCTTCTGCAGTACCT CACCAGGGAGCAT | SEQ ID NO: 1189 |
| TMPO | ADXCRIH.3127.C1_at | GAAATTGTGAGAAGCTTCATTTAGTGTTTAAAAATGTGGGGAGATAAATCAGACTTAACATG TATGTAAGATCAATTCACTTAAAAGTATGGTCCAAATAGCAAAAATAGGACCAGGTGAAACA TGTAGTCATTTTTTAAAAACATGTACTTGGTCTTTTGTGTGTGTCTGTTTTATTCCATTAGA | SEQ ID NO: 1197 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| | | ATAAATGTGTCCTTGATGTAATGCAAAGCATTTCTTCCTGATTAAATTGTAGATGTAGACTTTAC | |
| TMPO | ADXCRIH.3127.C1_x_at | TCCCATACTGTTTTCAGCCTTTTGTTTATAATTAGAAATTGTGAGAAGCTTCATTTAGTGTTTAAAAATGTGGGGAGATAAATCAGACTTAACATGTATGTAAGATCAATTCACTTAAAAGTATGGTCCAAATAGCAAAAATAGGACCAGGTGAAACATGTAGTCATTTTTTAAAAACATGTACTTGGTCTTTTGTGTGTCTGTTTTATTCCATTAGAATAAATGTGTCCTTGATGTAATGCAAAGCATTTCTTCCTGATTAA | SEQ ID NO: 1198 |
| PTPN2 | ADXCRIH.138.C1_at | GCAAAGCAAGACCTGAAGCCCACTCCGGAAACTAAAGTGAGGCTCGCTAACCCTCTAGATTGCCTACAGTTGTTTGTTTACAAAGTAAACTTTACATCCAGGGGATGAAGAGCACCCACCAGCAGAAGACTTTGCAGAACCTTTAATTGGATGTGTTAAGTGTTTTTAATGAGTGTATGAAATGTAGAAAGATGTACAAGAAATAAATTAGGAGAGATTACTTTGTATTGTACTGCCATTCCTACTGTAT | SEQ ID NO: 1199 |
| LBR | ADXCRIH.2185.C1_s_at | TTGTTTTATCAGTGCTAATGTGTGCAAGCAGTTTTTTTATTTTGCTTTTCTCCTGGCATCAGAAAGTGGTGGCGTTTTCTGTACTGGATTGCACCAAGGAAGCTTTTGGGGAGGAAGGAAGGACATTAAATTCTTTCCCTGGTAATGAAAAGAGCCCTTTATCAATACAGTGCTGCAATTTCTGGATATCAGCTACACTTTGTTTT | SEQ ID NO: 1200 |
| SP110 | ADXCRIH.149.C1_s_at | ATCCTCAGTGAAGTGCATTCGGAATGAGGATGGAACTTGGTTAACACCAAATGAATTTGAAGTCGAAGGAA | SEQ ID NO: 1202 |
| SP110 | ADXCRIH.149.C1_x_at | ATATACGTTGTGAAAGGACGACCCTAGGAGAGCTGCTGAAGAGTGGACCTTTGCTCTGTCCTCCAAGAATAAATCTCCAGAGAGTTTAAATAGCAAGTGAATTTCTACTACC | SEQ ID NO: 1203 |
| TMEM176B | ADXCRIH.2580.C1_s_at | CCTTCGCCCTCTAGGGAGCAGACCTCCACTGCCATTGTCCTGTGAGCCGCCAAAGACCCCACGGGGTGCCCGCATGTCCCTGTCTAGGGCAGCCCAGGGCCCCCACTCCTGGCCTCTCACACTTGCCTCCCCTATGGCCGCTCTCCAGACCCTCCTCCTTTCTTCTCCCCACATCCGCACCTGCTGTTCCCACTCTGGGGTTCTCAAGTCCATGAACAGATATTGTTGCATTTTCCACAATG | SEQ ID NO: 1215 |
| ATHL1 | ADXCRIH.1963.C1_s_at | GATGTTCGCAGGAAAAATCTGGAGATTTACGAGGCTGTGACGTCCCCCAGGGCCCCGCCATGACCTGGAGCATGTTTGCTGTGGGCTGGATGGAGCTGAAGGACGCAGTGCGGGCCGGGGCCTCCTGGACAGGAGCTTTGCCAACATGGCTGAACCCTTCAAGGTGTGGACGGAGAATGCAGACGGGTCAGCGCTGTGAACTTCCTGACAGGCATGGGGGGCTTCCTGCAGGCGGTGGTCTTCGGGTGCACGGGGGTTCAGGGTCACCCGAGCGGGTGTGACCTTTGAC | SEQ ID NO: 1222 |
| PAICS | ADXCRIH.2946.C1_at | TTGAATTTACCGTCTTCTCATCCTCTGTACAAAAGCCTCAAGTGAGGGTCAAATTCAACATTATCCTGATCTAGACAGCCCCCATTCTCAATCCACCCTTTTCCAAGTTGATTGCCCAAGGACTTCTAACAATAAACTCTCTTTTTGCACCACAGACTTCTTTGAAAATATACATGCTGTTGACCCTCTCTGTAGAAAACCGCACACATAAAACTTACCAACAGATTTCATTGGTTCTTGGGTTCTCCCGAAGCCTATCCATGGTTTATA | SEQ ID NO: 1228 |
| MYB | ADXCRIH.2957.C1_at | ATCAAATGCAAAACTCCCAAATTATAAAACAGTCAGGCTACACTCAAAACAAAACATAGAACATCAACAACACACATCTCCCAAAAAAGAAGTGCAACGCATGCTTGTATAAACCAACAATAACAAAAAAACCACAATAAAAAATGCAGAGTCTCCCAAACAAGTTTTCAAATGTATTGCAGAAGNNNNNNNNNNNNNNNNNNNNNNNNNNNNNNNNGTCTGAAATACTAGTGCATAGTCAATTACCTAACACCAAGTT | SEQ ID NO: 1232 |
| REPIN1 | ADXCRIH.2978.C1_s_at | CTTTTCTCCATTTCTAGCATATGGACACCTGGCCTCTGCTTGAGCACTTAGGTGACAGGAACTTCCGCACCTCCTGAGGCCCTGGATGATTCTAATTGTTAGAAATTCTAATTGTTAGAAATCCTTCCTTATAATGAATGAATTCTGCTTTCCTATAATTTCTACCTATTGGGCCTTGTTCTGTTCTCTGGAACTAAAC | SEQ ID NO: 1236 |
| NCKAP1L | ADXCRIH.2983.C1_at | CGACCTTCATCCACTATTCTTATGATAATGCTGGCGGGCAGAGATGATCAATCTCCTATTAAATCAT | SEQ ID NO: 1237 |
| NCKAP1L | ADXCRIH.2983.C1_s_at | CAGGAGCCAGAGTTGATGAGCAGATCTGTGGAAGAACAATCCAGGGCTGAGAAATCGTAGAGCAGTGAGGCAGGCTGGGAGCATGGAGGACAGCTTATGGAAAAAGTTAGGGCGTGGGGCCACATGTGTGAATTTTAC | SEQ ID NO: 1238 |
| USH1C | ADXCRIH.2211.C1_s_at | ACCAGGGCCAGATAAGGAACAGCTCGGGCCACTCTTCTGAAGGCCAACGTGGAGGAAAGGGAGCAGCCAGCCATTTGGGAGAAGATCTCAAGGATCCAGACTCTCATTCCTTTCCTCTGGCCCAGTGAATTTGGTCTCTCCCAGCTCTGGGGGACTCCTTCCTTGAACCCTAATAAGACCCCACTGGAGNNNNNNNNNNNNNNNNNNNNNNNNNNNNNNNNNNNNNNAATTGCTGCCAGGATTGTCACTCCA | SEQ ID NO: 1242 |
| TMPO | ADXCRIH.994.C1_s_at | ATATCCTGGGATAGTGCATGTTCACCATCTATTTTGTCAGATAATGGGGCCTTTTAAAAAATAATACTTTGCTTTCATGATATATTGTATTTTTGTGGAAAGTTAAGTTTAGCAATATATACTCTAAAAGCAAATTTAATTTTTTTAAGCCATAAAGAAATTATACTATATCCCAGTATCTGTATGTCTGTATAAAGCAGTGTATTATC | SEQ ID NO: 1247 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| GCH1 | ADXCRIH.1611.C1_s_at | TTCTGAGCACTCAACTCATGTTTGGCATTTTAAAGTAAAAACAAGTGTGACTTCGAGGACCA AAGAAATTGTCAGCTATACATTTATCTTTATGAACTCATTTATATTCCTTTTTAATGACTCG TTGTTCTAACATTTCCTAGAAGTGTTCTTATAAGGTCTAATGTATCCACAGGCTGTTGTCTT ATTAGTAAATGCAAAGTAATGACTTTGTCTGTTTTACTCTAGTCTTTAGTACTTCAAATTAC CTTTTCATATCCATGATCTTGAGTCCATTTGGG | SEQ ID NO: 1252 |
| HNRNPA2B1 | ADXCRIH.840.C2_s_at | ACACAGTCTGTAAGCTTTCCCCATTGTTCGTAGTAGTTCCTCAAACTTTCTTCTGTGGTTTC AAAGCTTAAGCCACCAATAAAGAGCTTACGGAACTGTTCCTTTTCTCTCTCCATCGCGGACT CAGTCGCTTCAGCCCGATTTCCCGCAGCCGAGCGAGATGAGAGAGATCTCCGCGGACGAACA CGAACCGGACTCGTCCTGGCGCTGTAGTGAGAACTGCCGCTGCTCGAGAAACAACTCTGCGA | SEQ ID NO: 1263 |
| RPS6 | ADXCRIH.344.CB1_x_at | GACCAAAGCACCCAAGATTCAGCGTCTTGTTACTCCACGTGTCCTGCAGCACAAACGGCGGC GTATTGCTCTGAAGAAGCAGCGTACCAAGAAAAATAAAGAAGAGGCTGCAGAATATGCTAAA CTTTTGGCCAAGAGAATGAAGGAGGCTAAGGAGAAGCGCCAGGAACAAATTGCGAAGAGACG CAGACTTTCCTCTCTGCGAGCTTCTACTTCTAAGTCTGAATCCAGTC | SEQ ID NO: 1266 |
| DENND2D | ADXCRIH.1679.C1_s_at | GGTATTGCTTCAAACTGGTGTCTGAGATTTGGATCCCTGGTATTGATTTCTCAGGACTTTGG AGGGCTCTGACACCATGCTCACAGAACTGGGCTCATAGCTCCATTTTTTGCAGAGGTGACAC AGGTAGGAAACAGTAGTACATGTGTTGTAGACACTTGGTTAGAAGCTGCTGCAACTGCTCTC TCCCATCATTATAACATCTTCAACACAGAACACACTTTGTGGTCGAAAGGCTCA | SEQ ID NO: 1274 |
| PCBP2 | ADXCRIH.132.C4_s_at | GAGATGTTGATACGTGCACCACTCTCCTCGCGCATCTTCTTAACTGATTCTCCTTTCTTTCC GATGATACTGCCAACTTCCTTTCCATGCATAAGTAGCCGGATGGTGAGAGTGACATTTAATC CACCTTCAATCACACCGGTGTCCATGTCGAGCAGTGTTCTGGGGAGCTGGACTTTGAGTGGT CAAGTCTTTGGTCACTGGT | SEQ ID NO: 1286 |
| HMGB1 | ADXCRIH.157.C4_s_at | TTTAGTAGGTACGTCATGACAACTACCATTTTTTAAGATGTTGAGAATGGGAACAGTTTTT TTAGGGTTTATTCTTGACCACAGATCTTAAGAAAAT | SEQ ID NO: 1289 |
| RPLP0 | ADXCRIH.6.CB1_s_at | CAAACGAGTCCTGGCCTTGTCTGTGGAGACGGATTACACCTTCCCACTTGCTGAAAAGGT | SEQ ID NO: 1292 |
| NAP1L1 | ADXCRIH.187.C2_s_at | TGAAAACTTCCTTTCTGAGAAGTTAGTGTTAAGGTCTTGGAATGTGAACACATTGTTTGTAG TGCTATCCATTCCTCTCCTGAGATTTTAACTTACTACTGGAAATCCTTAACCAATTATAATA GCTTTTTTTCTTTATTTTCAAATGATTTCCTTTGCTTTGATTAGACACTATGT | SEQ ID NO: 1301 |
| PSMB10 | ADXCRIHRC.3674.C1_s_at | TCACCGCCGGGATCTTGGGTGACCTGGGCTCCGGGGCAATGTGGACGCATGTGTGATCACA AAGACTGGCGCCAAGCTGCTGCGGACACTGAGCTCACCCACAGAGCCCGTGAAGAGGTCTGG CCGCTACCACTTTGTGCCTG | SEQ ID NO: 1307 |
| IL2RG | ADXCRIHRC.841.C1_s_at | ATGCAACCAGCATAGCCCCTACTGGGCCCCCCCATGTTACACCCTAAAGCCTGAAACCTGAA CCCCAATCCTCTGACGAAGAACCCCAGGGTCCTGTAGCCCTAAGTGGTACTAACTTTCCTT CATTCAACCCACCTGCGTCTCATACTCACCTCACCCCACTGTGGCTGATTTGGAATTTTGTG CCCCCATGTAAGCACCCCTTCATTTGGCATTCCCCACTTGAG | SEQ ID NO: 1316 |
| TMPO | ADXCRIHRC.3127.C1_at | TGAAATCAAAATTGTGTGCTGGTCTAAATATACATCTTCGGCTTCTTCCTTTTTAGTAAGTA TTTTTATTTCAGATGTATTTAAAAATAACTTACATTTTTAGTGTGCTTTATGGTCAATGACT GTAAAGTTGAAACTCAAATGAGTCAGTTTAAAATTTTTGTCTCATTTGATTCTATTGAAATT TTAATCACCTACTACTTTAATCAAGTTATTCATGAGGTAAGTTTCAGCT | SEQ ID NO: 1320 |
| MYB | ADXCRIHRC.2957.C1_s_at | GATGTGTGTTGTTGATGTTCTATGTTTTGTTTTGAGTGTAGCCTGACTGTTTTATAATTTGG GAGTTTTGCATTTGATCCGCATCCCCTGTGGTTTTTAAGTGTATGGTTTCAGAACTGTTGCA TGGATCCTGTGTTTGCAACTGGGGAGACAGAAACTGTGGTTGATAGCCAGTCACTGCCTTAA GAACATTTGATGCAAGATGGCCAGCACTGAACTTTTGAGATATGACGGTGTACTTACTGCCT T | SEQ ID NO: 1325 |
| REPIN1 | RDCR241_B04_at | CCTGTGCACAGTCTGACACTGGGAATGAGTGACCTTTGTGTTCCCTGAGAAGAGAGAGTGCG CTCTAGGGAATTTAGAAGGATGTGTCTGGAGCTTGTGAGCAGGCACGAAGGGCCCTTAGGA GCCTAACTGCTTCCTTCCTCCTTCCGCGGAGGAGGCTCCTGTGCAGGAATCTGGGCTCCCCT GAGCTGTGGAAGAGCTGAACATGGGGCAGCCCCTGGCGAGGTTGGGGCAGGACCGGGCAGGG GACTGAGATTGCAGTCTCATCTTCCC | SEQ ID NO: 1339 |
| RNF44 | RDCR179_F10_x_at | CTGGGCGAATCCTCCAAGGAAGTCCCAGGAGGATGGGGACCAGGAAGGCTGTGGACCCCC ATCTCCAGGGGGCCTTCCCAGCCTGATCCCTGTCCTCCAAGTTCTGGAGGAGGCCGGTGTAG GGTCTGGCTGAACTTCCCACCCACTTTCCCTGGTCCCAATCCTTTCTTGTCCTATACCAAGC TGGGGTTGCTGCCTTGAACGAACTGCGTGTGTTTTCGTCACATCCTATCAGGCAGCCCCTGG CGTCTGCTGCCTCAGGTATGCTCCAA | SEQ ID NO: 1351 |
| LGALS9 | RDCR039_D09_at | CATAAGGAGACTAGGCAGCCATGGGTAACACCTCACAAGGAAATGAGCGTGTTATCTGTATA GTGGTGTCACTCTGGCTGAATGTCAATTTAGGTGATTACTTAAAGGCCATTCACCTGATAGG GCTGGGGGTCCCAGGGGTGAGAGGTGGGGAGGGGATTCTTGCTCACCTTGAAATCTGAGCTC | SEQ ID NO: 1354 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|------|----------------|----------------|-----------|
| | | TGCACCAGGAAGCAGAGGTCAAAGGGCATCTCCTTCTGGAAAGGCATGTGTGTCTTCCTCTC CCTCGGGCCCCCAGCTTCCGTTCTGCCTCGTGTTG | |
| LRMP | RDCR162_D09_s_at | TCCTGGGCAACAAATCTCAAGTCCTCCATCAGAAAGGCTAATAAGGCTCTCTGGCTCTCTAT TGCATTCATTGTACTGTTTGCAGCTTTGATGAGCTTCCTCACAGGCCAATTATTCCAGAAGT CTGTGGATGCCGCTCCCACACAGCAAGAGGACTCATGGACGTCTCTAGAACATATCTTGTGT CATTTACCAGACTCGACACAATGGGCCACCACCAGTGTGACAGCAGACATCCTAATATATGG ATCTTGAT | SEQ ID NO: 1359 |
| GTF3A | RDCR434_D07_at | AGGTTAAAGCAGTTGGGAGTCCATACACAGCCTACCCAACTTCCTGAAACTCTTAGAGAGGA AAAGGCATCCTTAGGCATCCTTCCTGTGAAGTTTGCCTATTCCTGATCACGCTGAGAAGAT GGGAACTCTGAAGTTTGCTTCACAAGAAGGTAAAATCCTTAAAGGGAGGCACCTTGCTGTGC CACTGTTCAGTTTTACTATAACATCAATCTTTTTTTAGTTTTTATTCCCACCTCAAGAGGCT GAGTTGAATACTATTAGGC | SEQ ID NO: 1369 |
| CALML4 | RDCR490_C03_at | GGGAGCAGCACGAACTCCTGAAGACTTGGGAGCGTCAGCAGCTTCTGCGGAAGGGGTGGGGC TGAGGGTGGAGAGAGGAAGGGAAGGAAGAAAAGGGGAGCCTTCCTGGCCAGGGTAACCGGCA CTAAGAGGCCTCACTCCAAGCCCCCGAGGAGCCTGTGGTGGGGCTGGAGACCCGGGCTCAGC CCTCCACCACCCTTAAAGTCCTCAGAAGGTGGGAACTGAACTGGGCACAGGCTGGGAAACC GGCTGTGCGCTGGGCACTTGGAT | SEQ ID NO: 1373 |
| CALML4 | RDCR490_C03_x_at | GAGCAGCACGAACTCCTGAAGACTTGGGAGCGTCAGCAGCTTCTGCGGAAGGGGTGGGGCTG AGGGTGGAGAGAGGAAGGGAAGGAAGAAAAGGGGAGCCTTCCTGGCCAGGGTAACCGGCACT AAGAGGCCTCACTCCAAGCCCCCGAGGAGCCTGTGGTGGGGCTGGAGACCCGGGCTCAGCCC CTCCACCACCCTTAAAGTCCTCAGAAGGTGGGAACTGAACTGGGCACAGGCTGGGAAACCGG CTGTGCGCTGGGCACTTGGATTTTGCCAGCTGC | SEQ ID NO: 1374 |
| RPS6 | RDCR236_E11_at | ACATACTTTGTGCATTTTTCACTGATCCAAGAATGTTTTTAGTCATTTCCTTTTCAGTGTGT GAACAGCCTAACAATTCACTGGAGTTGAAAAGCTTTGTTAAAACAAATTTGAAATGCTTAA AAACCATTTAGTGGATGGTATCCACTAAAACTAGGTATCCACTAAAACTATGCCTTAAAAGT TACCTTTTAAAAAGACATGTTCATCTTCACAAGGTCAATTTTCATGTATTAAATTGTGTAT AGTGCTTTAAAGAGCTATATTCCTCAAAAATA | SEQ ID NO: 1377 |
| GTF3A | ADXCRIHRC.2186.C1_s_at | GGCCTCTCATCTCAGTGGATATATCCCTCCCAAAAGGAAACAAGGGCAAGGCTTATCTTTGT GTCAAAACGGAGAGTCACCCAACTGTGTGGAAGACAAGATGCTCTCGACAGTTGCAGTACTT ACCCTTGGCTAAGAACT | SEQ ID NO: 1382 |
| RPL10A | ADXCRIHRC.799.C2_s_at | AGGTGTTATGTCTGGCTGTAGCTGTTGGTCACGTGAAGATGACAGACGATGAGCTTGTGTAT AACATTCACCTGGCTGTCAACTTCTTGGTGTCATTGCTCAAGA | SEQ ID NO: 1384 |
| BLM | ADXCRPD.16944.C1_at | TTAGGGCCTTTGCTCTAGCCAAAGCTTCTTGCAGGAAAGCTCACATCCAGGGAGCTGCCAGC TAACTCCCTTCTTCAAGATTTTCCTCAGCTCCCATCTTCTCAGTTAGACTTCCAAGGACCAC CCCGTCTAATACTGCATCCTGCACTCTACCCATTCCTCCTGTCTTTTTACTCTGCTGTGCCA TTCACCACAGCTCTTATCCTTTCATGTATATTTATTGTGTATATTGTTTGTAACTGGCCTCC CTCTCTGCTAGAGTGTAAG | SEQ ID NO: 1385 |
| SLC19A1 | ADXCRPD.7962.C1_s_at | GCCGCGGGCTTCGTGAAGATCCGCTGGGCGCGCTGGTCCAAGCTGCTCATCGCGGGCGTCAC GGCCACGCAGGCGGGGNCTGGTCTTCCTTCTGGCGCACACGCGCCACCCGAGCAGCATCTGG CTGTGCTATGCGGCCTTCGTGCTGTTCCGCGGCTCCTACCAGTTCCTCGTGCCCATCGCCAC CTTTCAGATTGCATCTTCTCTGTCTAAAGAGCTCTGTGCCCTGGTCTTCGGGGTCAACACGT TCTTTGCCACCATCGTCAAGACCATCATCACTTTCATTGTCTCGGACGTGC | SEQ ID NO: 1389 |
| PPRC1 | ADXCRPD.9220.C1_at | CAGGTATTGAAACAAGTTAACTTGCATTCCTATGTAAGATAGGAGGGGCTGAGGGGATCCCC AGTGTTTGGAACATAAGTCACTATGCAGACTAATAAACATCAACTAGAG | SEQ ID NO: 1398 |
| PPRC1 | ADXCRPD.9220.C1_x_at | TCCCTGCTATCCTTTTCTCCTTTGGAGGTGCNCAACCTCCTCCACCCCCTTCCCCTACTC TAGGGGAGAGAGCTGCTAGTGAGATGACTGTTTTATAAAGAAATGGAAAAAAGTGAAATAAA AAATATGTTGAATCAGATTTTTAAAAGGGGTATTTGTTTTTTTATAACAGGTATTGAAACA AGTTAACTTGCATTCCTATGTAAGATAGGAGGGGCTGAGGGGATCCCCAGTGTTTGGAACAT AAGTCACTATGCAGACTAATAAACATCAACTAGAG | SEQ ID NO: 1399 |
| ITM2A | ADXCRPD.18289.C1_at | GTAACCTTGGCATCTTTATTTACCAACTTTGCAATAACAGAAAGTCCTTCCGCCTTCGTCGC AGAGACCTTGCTGGGTTTCAACAAACGTGCCATTGATAAATGCTGGAAGATTAGACACTTT CCCCAACGAATTTATTGTTGAGACCAAGATCTGTCAAGAGTAAGAGGGCACAGATAGAGTGT CCTTGGTAATAAGAAGTCAGAGATTTACAATATGACTTTAACATTAAGGTTTATGGGATACT NNCAGATATTACTCATGCATTTACTCTAATGCTTTATGCTTTA | SEQ ID NO: 1403 |
| AQP3 | ADXCRPD.10405.C1_at | GGGCCACAGATTAGGTTGGAGCTCTGGATGTACATACATAGTATGAGCAGTGGGACGTGTTT CTGTCTTAATGCAGGCATCAAGGGTGGAGTGAAGTCAGGTCATAAGTGTCATGTCCGCTTGG GTTTTGTTTTGTTTTTAATGTATGTAGCAGATGTTACAGTCTTAGGGATCCGGGATGGGAGA CCCCACTTTAGAAAGGGTCGTCACTCCTTTAATCCTCTACTCAACAATGTACTCTTTTA | SEQ ID NO: 1410 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| PAICS | ADXCRPD.2080.C1_s_at | GCTCTGATGTGCTATGCTTAGCTATCTGTCAGAGATTAGTAAATTATAAAACTCATGTGTAC TACTTAAGTTTATATCTTATGCTAGTTTATAAGAACAATTAAAAGGACTTAGAAGATTAACT TTGGTTTCATGGTCTCTGAAGTCACTGACTGCTATTTCAGCTTGTTTACCCTTACCTAGCAT TAAGACTCCATCTACTTCTGTGCAGTATATGAAAATTTTTAAACTTTCATTTAGACTGGTGG ATAGGACTGACCATTACAAATTGT | SEQ ID NO: 1415 |
| GMFG | ADXCRPD.1437.C1_at | TGATCTCTGGGCTGGGGACTGAATTCCTGATGTCTGAGTCCTCAAGGTGACTGGGGACTTGG AACCCCTAGGACCTGAACAACCAAGACTTTAAATAAATTTTAAAATGGCGCCAGGCCCCCCC ACGTAAAAGAAAANAACTTGTTCGGCCGCCCTCGGCCCCTCAAAAAACTTTTCTAAACCCTT TCGTTTGGGCCCCCGGGGCCCACTTAGGTAAGGGAAAAATGGGGCCTAAACCTGTTTCCCTA GGAAAATCCCTTGGCCATGAACTAA | SEQ ID NO: 1417 |
| USH1C | ADXCRPD.18376.C1_s_at | GTCCATCAAAGTGAGACACATCGGCCTGATCCCCGTGAAAAGCTCTCCTGATGAGCCCCTCA CTTGGCAGTATGTGGATCAGTTCGTGTCGGAATCTGGGGCGTGCGAGGCAGCCTGGGCTCC CCTGGAACATCGGGAAACCAAGGAGAAGAAGGTCTTCATCAGCCTGGTAGGCTCCCGAGGCC TTG | SEQ ID NO: 1421 |
| ATP5G2 | ADXCRPD.11199.C1_s_at | AAGAATAGACTAGGGCCTCAGTCTTACACTTCTTGACCACACCTGAATCTTAAAGGCATTTG AAGTCTACATCCTACGTTAAAAGGTTCTACTTGCCAGCATTTTAGGGCGTTAAACAA | SEQ ID NO: 1439 |
| IL2RG | ADXCRPD.2198.C1_at | AACCACTGTTTGGAGCACTTGGTGCAGTACCGGACTGACTGGGACCACAGCTGGACTGAACA ATCAGTGGATTATAGACATAAGTTCTCCTTGCCTAGTGTGGATGGGCAGAAACGCTACACGT TTCGTGTTCGGAGCCGCTTTAACCCACTCTGTGGAAATGCTCACCATTGGAAGTGAATGGAG CCACCCAATCAACTGGGGGAGCAATACTTNCAAAAGAGAATCCTTTTCCTGGTTGCAT | SEQ ID NO: 1440 |
| LCP1 | ADXCRPD.1593.C1_at | GGGTGTAATGGGAGCATCCAGCCACTCGGCGGGCAGCATGGAGCTATAAACTAGCCATCCCT TTTAGGGGTTCTGC | SEQ ID NO: 1444 |
| LCP1 | ADXCRPD.1593.C1_s_at | GAAGTAAGCCTCATCATCAGAGCCTTTCCTCAAAACTGGAGTCCCAAATGTCATCAGGNNNN NNNNNNNNNCAGCCACTAAGAACCCCTCTGCTTTTAACTCTAGAATTTGGGCTTGGACCAGA TCTAACATCTTGAATACTCTGCCCTCTAGAGCCTTCAGCCTTAATGGAAGGTT | SEQ ID NO: 1445 |
| TAPBPL | ADXCRPD.18421.C1_at | TTTCTGCTGCTCCAGATAGAGCCAGGCAGAGCAGCAGGCACCAGCCCTCCTGTGTGCCCATG GAGGCTGCTCTCGAGTTCCCTCCTTGCCCACCGCCCGTTCTCCACAGTCTACGCTGCTTGC GAGGCCCGGCGAAGAAGGGGGCTCTCCAAGCACACACTGGCAGCCTGCAGCCTTTAGGTTT CTTCCCCTGTTCCCTGCTGCATCCTCGGGATTTCGCGCACCCCATTAATCTATTCTCGGAGT CGGGTGGGT | SEQ ID NO: 1446 |
| MDN1 | ADXCRPD.8864.C1_s_at | AAAGCAGTGCTGAATACTTGAAACTGTGTGCTCTGTTCTACTTAATGTTCTGTCAGAATGTT CTTTTGTAGGCAGTATGTCATGATGTAATCATCTATCTCCTTGTCTGTTTCCAAGTTACACT GTGAAGTCTGCGACCCTTTTGAGGTGGTCATCAAAGACACAGATTCCTTGTTTAACCAAGTG TCCCAAAGCATGTACCTGAAGTTATATCAT | SEQ ID NO: 1455 |
| SP110 | ADXCRPD.2201.C1_s_at | AAGCACTTCAGTGACCAATGACAAGTTAACATCCAAAATGAATGCGGAAGAAGACTCAGAAG AGATGCCCAGCCTCCTCACTAGCACTGTGCAAGTGGCCAGTGACAACCTGATCCCCCAAATA AGAGATAAAGAAGACCCTCAAGAGATGCCCCACTCTCCCTTGGGCTCTATGCCAGAGATAAG AGAT | SEQ ID NO: 1456 |
| CXCR4 | ADXCRPD.2235.C1_at | TGGGATCAGCATCGAATTCCTTTCACCTCCTGGAAATCCATCAAGCCAGGTGTACATTTGAA AACC | SEQ ID NO: 1458 |
| CXCR4 | ADXCRPD.2235.C1_s_at | AGATATATCTGTGACCGCTTCTACCCCAATGACTTGTGGGTGGTTGTGTTCCAGTTTCAGCA CATCATGGTTGGCCTTATCCTGCCTGGTATTGTCATCCTGTCCTGCTATTGCATTATCATCT CCAAGCTGTCACACTCCAAGGGCCACCAGAA | SEQ ID NO: 1459 |
| NFATC3 | ADXCRPD.9584.C1_at | AGCCTATGCTGCTCCTGTTCTTTTGCCAAATCTACCCAAGGCCTGAGGTGGAGGAATGCTAC TTTCCCCACAAATGGTGGGTCCCACTCCTGGCCCCAGACCTGAAGGCTGCAGAGTTGGAAAC CCAAGGTCCAAGGAGAGA | SEQ ID NO: 1470 |
| MYB | ADXCRPD.10703.C1_s_at | AAGCTTCCAGAAGAACAGTCATTTGATGGGTTTGCTCAGGCTCCGCCTACAGCTCAACTCCC TGCCACTGGCCAGCCCACTGTTAACAACGACTATTCCTATTACCACATTTCTGAAGCACAAA ATGTCTCCAGTCATGTTCCATACCCTGTAGCGTTACATGTAAATATAGTCAATGTCCCTCAG CCA | SEQ ID NO: 1479 |
| USP7 | ADXCRPD.11382.C1_at | GAAATACTTGCCTAAGTTTCCCTGATGCTTTCTCCCCAAGCTCCACGGCCTTTTTACATTCT TCTAACAGGTCCCGGACACACCCATGCTTGTCTGGATATAGTGTTATTTCCTAAGTAATGAA AAGATAAAATAAGTGCTTTCAAGAAAGCATAAAAGGTCTGCTACCACAAAGGAAGAGAGGAG AAAGTTGCATCATTGTTCTCAACTGTCCCCAGCTGGCCCCCATGTTCTTGCTCTCATTCCNC ACCCCAACTCCCTCATCTGTGAATTCACTC | SEQ ID NO: 1480 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| BLM | ADXCRPD.11385.C1_s_at | GGAGAATACAGCTTTTGGCCTACTTTGGTGAAAATGGATTTAATCCTGATTTTTGTAAGAAA CACCCAGATGTTTCTTGTGATAATTGCTGTAAAACAAAGGATTATAAAACAAGAGATGTGAC TGACGATGTGAAAAGTATTGTAAGATTTGTTCAAGAACATAGTTCATCACAAGGAATGAGAA ACATAAAACATGTAGGTCCTTCTGGAAGATTTACTATGAATATGCTGGTCGACATTTTCTTG GGGAGTAAGAGTGCAAAAATCCAGTCAGGTA | SEQ ID NO: 1481 |
| HCLS1 | ADXCRPD.1749.C1_at | ATAAAAACCTCCTTGTTCGCTGCAGCCCCGGGGGGTGTAAGGGGGAAATTGGCGGCCCTGGG CCATACGGAAAACAAGGCGCCGTGACACTCCAACAGAAGATCGGCACCGTCCCATCCACACG GCTGCAAACTTGCGCCAAAATGCATCTAAACCACGAGAACGCCCGGGGGGGATCCACCCCGC GTGGGCACGCCGCGGGGAGAGAGGGCGAACGCCGAAACCCAGGTGTGGCGAGCAAAGCTACC CCATAAAACCT | SEQ ID NO: 1483 |
| 41888 | ADXCRPD.2412.C1_at | GCTTACAGCGGCGATACAGCTCATAGTGCCGGGTGTGGGTCTGCTCCCGCAGATCCTCCATG TTGACCCGAATCAGCATCTCCCGCAGCTTCACAAAGTCGCAGTGGGCCTCGTTTTCAACCTG CACAGTGCCCCAAG GATACTGCCGCCCTCATCATCTTGTTGCCTATCTTCAGTTCTTCT GTGCTGCCAATGACAGCAAACGGCAGGTGGGCGTTCATGGTTCCATTGATCTCTGCCACCGA CTCATCATCTGTAAGGAAACTGATAGATCTGGACTCCGTT | SEQ ID NO: 1492 |
| NAP1L1 | ADXCRPD.3079.C1_s_at | TCAAAGATAGAATCCCATTTTTAATGAACTGAAGTAGCAAAATCATCTTTTTCATTCTTTAG GAAATAGCTATTGCCAAAGTGAAGGTGTAGATAATACCTAGTCTTGTTACATAAAGGGGATG TGGTTTGCAGAAGAATTTTCTTTATAAAATTGAAGTTTTAAGGGACGTCAGTG | SEQ ID NO: 1494 |
| CD53 | ADXCRPD.1819.C1_at | GGTTGCTATGCGAAAGCAAGACTGTGGGTTCATTCCATTTTCCTNATATCGNGATCATCACC ATCTGTGTATGTGTGAATGAAGGTTTTGGGGATGTCCTTTTGCCCTGACCCTGAACTGNCAG ATTGACAAACCCAGCAGACCCATAGGGTATTGATCTGCAGNAANTCCTTGGGGTGGAAAGAA ACTGGTTTCATCTTCG G GAATG CCAAACCATTTTATAG CATG GAG CCCCTACCTGT | SEQ ID NO: 1497 |
| MSH2 | ADXCRPD.1845.C1_at | GATGTTCCACATCATTACTGGCCCCAATATGGGAGGTGAATCAACATATATTCGACAAACTG GGGTGAAAGTACTCCTGGCCCAAATTGGGTGTTTTGTGCCCTGTGGAGTCAGCAAAAGTGTC CCATGTGGGACTGCATCTTAACCCCAATAGGGGGCTGGTGACCATTCAATTGGAAAGGGATC CTCCC | SEQ ID NO: 1501 |
| FABP5 | ADXCRPD.277.C1_x_at | GTGTGTTGGATTAATTAGGATCATCCCTTTGGTTAATAAATAAATGTGTTTGTGCTAANNNN NNNNNNNNNNNNNNNNNNNNNNNNNNNNNNNNNCNNNNNNNNNNNNNNNNNNNNNNNNNN NNNNAATATGTTCGGGCCGCCTCGGGCCCTTCAAAAAACTTTTTCAAGAACCATTTCGTTTT GGCCCCGCGGGCCCCAATAGGGTAAAGTGAAAACTTGGCCCATACCTTGTTTTCCCATAGG AAAATCCCTGGGCCATTGAACAAAGG | SEQ ID NO: 1504 |
| ARHGAP15 | ADXCRPD.9769.C1_at | AAAAACATCTTCAGTGCTCCGGTGACAACGTGGATGTCCTCCCACTGGCTGTCGTCCAAATT CAGCTTCTCTTCAGTTTAATGAAGTGACAAATTATTGGCTTGCTCTGGAGGTCAAATGACCA CTGTGAAAAATCTGCAGCTTACTAGGGGTGTCCACAGGTCTCCATCCAGTTCTGATAGAAGG GCTGGTATTCCAGAAACGACTTGGTTGACAATAAATCTTAACTTCTGTATTGTTGCCAGATT GCCACTAACTCGATATATTCCATCAACATCTAGACCTC | SEQ ID NO: 1508 |
| PTPN2 | ADXCRPD.12103.C1_s_at | CGGCCCTTGCGCCTTTCTAGCATAAAGTGGTGTGTCAGAGCCACTGTCTCCACAGAAAGCAC CACGTTTGTTTCATTTGACTTATTTGAACCCGTTTCTCCTGCCTTTGCCTTTTTAAATAAAA ATAGCAAAAATTGATTCAAGTGAATCTATTAGAATTTTCTAAAATGGAGCCCATTTGTCTTT TCAGTCTTGCAAGTAAAGTCTTTAAAACAATTAAGCCTCCCAATGATTTAACCGTATT | SEQ ID NO: 1509 |
| PTPN2 | ADXCRPD.2533.C1_at | CAGTATTACACAGTGGGAGGTCCAAATTGGATTAGACTTTGGCATTGAATTCCAAAGTATTG GTAAGTCTAGCACATACTATAAAGGCTTTGCTAAATTCTGGTGGGTACATTATTTTTAAAAC CTGTCTGTCTGTCGGTATCACACAGAGGTCACTTCTTGAGTAAAATAAGATGACCTTAAGAA TTCACATAATTCTTGAAGAAGAATATAAGTCACGATGCTTCCACATGAGGCCGCGTCACACC ACCATCGTTTGGAAATCCAGCACCTCAGCCGT | SEQ ID NO: 1523 |
| P2RX5 | ADXCRPD.2544.C1_s_at | AGAGTTCCTAGATTACCTCACTGGGAATAGCATTGTGCGTGTCCGGAAAAGGGCTCCATTTG GTTCCAGCCCACTCCCCTCTGCAAGTGCCGCAGCTTCCCTCAGAGCATACTCTCCAGTGGAT CCAAGTACTCTCTCTCCTAAAGACACCACCTTCCTGCCAGCTGTTTGCCCTTAGGCCAGTAC ACAGAATTAAAGTGGGGGAGATGGCAGACGCTTTCTGGGACCTGCCCAAGATATGTATTCTC TGACACTCTTATTTGGTCAT | SEQ ID NO: 1524 |
| ALDH5A1 | ADXCRPD.1911.C1_at | GGGTGTGGCTATGCTCTAATAACATTTTGTTTATGGACACTGAAATCTGAATTTCATAGAAT TTTCAGGTGTCATGAAATATTGTTCTTCTTTTGATTTTCTGCCCAATCATTTGAAACATAT AAACCATTCTTAGCTCACAGGTTGTATAAAAACAGGTGGCAGGCAGGTTTGATTCGTGGGC CATAGTTTGCCAACCCCTGATCTAATGGTCCTTTTCTAGTCCATGTTGTAAAATGTATATAT TTTTAAAATCCCGTTACATATGGCTACTTTA | SEQ ID NO: 1528 |
| CYFIP2 | ADXCRPD.9810.C1_s_at | CCATGCCGAGCGCAGGAAGGACTTTGTCTCTGAGGCCTACCTCCTGACCCTTGGCAAGTTCA TCAACATGTTTGCTGTCCTGGATGAGCTAAAGAACATGAAGTGCAGCGTCAAGAATGACCAC TCTGCCTACAAGAGGGCAGCACAGTT | SEQ ID NO: 1540 |
| MSH2 | ADXCRPD.12253.C1_at | CATTTCACGAATAAAAGTTACTACGTGAAAAATCCCAGTAATGGAATGAAGGTAATATTGAT AAGCTATTGTCTGTAATAGTTTATATATTGTTTTATATTAACCCTTTTTCCATAGTGTTAAC TGTCAGTGCCCATGGGCTATCAACTTAATAAGATATGTAGTAATATTGTACTTTGAGGACAT | SEQ ID NO: 1544 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| | | TGTCAAAGATTTTTATTGTGAAAAATGAGAGCTGTAACTGAGGACTGTTTGCAATTGACATA GGCAATAATAAGTGTTGTACTGGA | |
| IGJ | ADXCRPD.2619.C1_at | GGTACACAAATCTGGTTCTCAATGGTGAGGTGGGATCAGAGATATTCTCCCTGTTGTTCAGA GGAACAATAATTCGGATGTTTCTCTCCACAATGTCCTCATTAGGATCTTCGGAAGAACGGAT GATCCTGGAAGTAATCCGGGCACACTTACATTTGTTGTCAACAAGAACAATCCTTTCATCTT CTTGGGCTTTCACATGAACAGCCTTAATAAAAACCGCCAGGACTCCCCAGAAAAGCAAATGG TTCTTCATCTTGACTTC | SEQ ID NO: 1546 |
| UTP3 | ADXCRPD.2675.C1_at | AGCTTAGGGAAATTTCACAGTTCATTGTGGAGTGTTAAACTTAGAACATGTGTAACTTTTCA CATAAAGAGAATGCATCTTTGACAGTTATCTTATTTGTAAGGCAGCCTATAAAATAGTTCTG AAGTATTTTATTTACCTAACTATAATTATTGGGCCAGATACTTGTTAATAAATGGGCTTAAT GTTAACATGGATTTCATATGTTCTGTGTGGT | SEQ ID NO: 1550 |
| RNPS1 | ADXCRPD.500.C1_at | ATGCATAGATATACACACCACGCCCCCACCGCGATGTTAACGACACCGCGAGATAATACTAT TCCCCCCACACTGCGTCTCTGTTCGTTTCTNAGCACACCTCTCACCTCTCCTCTTATCTCT GTGGCGGTCGAGAACATTGCACTCACCCCACTATTTATCTCTATTCTTTCTCTATTACTGAC CAACATATCCTCTGTGCGCACCCTCGCGCGGAAACAACAACATCGTGTACACACCACAAGAA GTAAGCACATGATTGCTAGCCTGGGACACCGCGCCCTCATAATATATA | SEQ ID NO: 1561 |
| PIM2 | ADXCRPD.4065.C1_at | AATGTAAATAACTCACGTATAGTGGGGAGGGGAGTTCCAAGTGTGCCCTCCTCTCTTACTCC TGCCTGGATTATTTAAAAGCCATGTGTGGAAACCCACTATTTAATAAAAGTAATAGAATCT GCAAAGTTGGACGGAGCGAGAATTCGT | SEQ ID NO: 1573 |
| PIM2 | ADXCRPD.4065.C1_x_at | TCCTGAGCCGGGATTGTCCAATTACTAAAATGTAAATAACTCACGTATAGTGGGGAGGGGAG TTCCAAGTGTGCCCTCCTCTCTTACTCCTGCCTGGATTATTTAAAAGCCATGTGTGGAAAC CCACTATTTAATAAAAGTAATAGAATCTGCAAAGTTGGACGGAGCGAGAATTCGT | SEQ ID NO: 1574 |
| GCH1 | ADXCRPD.4094.C1_at | AAGTCATTACTTTGCATTTACTAATAAGACAACAGCCTGTGGATACATTAGACCTTTATAAG AACACTTCTAGGAAATGTTAGAACAACGAGTCATTAAAAAGGAATATAAATGAGTTCATAAA GATAAATGTATAG CTGACAATTTCTTTG TCCTCGAAGTCACACTTGTTTTTACTTTAAA ATGCCAAACATGAGTTGAGTGCTCAGAATTCTACCTATAAATGTCTAAATATTAAGCAGGCT | SEQ ID NO: 1577 |
| TTF1 | ADXCRPD.2906.C1_at | AAACCCGCGCTAGGTAAATTCTGCTATCTGGCCGTCAACACGCTGTTTTCACCAGCTCATCT AGTCGCGCCTGAATAGTAGCGCCGCTACCCGCGGGCCCGCGTCTATTTCTTTTATTAGTCG CCGCCCGCGCGGTGTGCATTATATCTCAATCCTTGCGAGTCGCGTGAATGCGGAGCGAATTTG TGAGNCACGCGAGTGGGCCGCGCCGCACGGGGACGCCTTTCGCTNCCCATCATTCCCACTTT ACGGCCGTCCGGCCCAGCCGGTCGCGTATTACTTGCCGGTGGC | SEQ ID NO: 1598 |
| LBR | ADXCRPD.2923.C1_at | TTAAGACAGCACTCCTTTACAGGGAGTCAGGTTTGGTAAATATAAAGGATACATAAAAAATA CAGTATAAACTGCATAAGCTTAACAGTAGCAAAAACACTGATGAACTTTTAAAAAGTCAAAA ATATATAAAAATATTAGCCTGAAATGGCAAATTTTCAAACACCGATCTGTGTAA | SEQ ID NO: 1600 |
| TMPO | ADXCRPD.3658.C1_at | TTGTTCACAGTGTTGGCACATGGTAAGGGCTAAGACACTTGATTAGCATAATATTCAAAATT AGAAATTGTACACTATTGTACTCTCTTTCAAAAGGCAAACAGCCTAAAACTGTTTGGAAAAA ACAGCTTGTACAGTATATTGTACACTTCCTGTGATAGACTAGTGGACTGATACACCCACTAA TGCACAGCAGTAATAGTCCACCTCTTTACACANTTATGCATGTTAAGTGACAAAAAACTCA CTTTAAAAGGCCAAATGATAAAAACATCAGCCTTGAGGCTCTTCGATATAGA | SEQ ID NO: 1615 |
| IGJ | ADXCRPD.4305.C1_at | GGCAATTTCTTACACTAACCTGATTATGAAAAAAGAAGTCTGTATCATCTGCTTCCAAGTC TGTTATGTCCAAATATATTTTAATTATGCATTTATTTTGCTACTTTTATAAAATATTAGAGAT TTCACCTTAAATTATTTTTGTAACTAGTTCTAGAACATGTTTTCCAATTATTATTTTTCTAA TGGAGACATATAATTGACCTATGTTTATGCATATATGTTCTCTACACAGTGAAACTTTTTTT AAAAAGAATAGTAAAGAAAATGCGGAAGCTCTGGCTCTCCAAG | SEQ ID NO: 1619 |
| ICAM2 | ADXCRPD.4332.C1_at | GAGGCTGCCCCACCGTTCCGGCCATAGCAACCATGAGTGGCATGGCCCACACCACGGTGG | SEQ ID NO: 1622 |
| ICAM2 | ADXCRPD.4332.C1_s_at | TGTCGGTGTTGCTGTCCCTGTTCGTGACATCTGTCCTGCTCTGCTTCATCTTCGGCCAGCAC TTGCGCCAGCAGCCGGATGGGCACCTACGGGGTGCGAGCGGCTTGGAGGAGGCTGCCCCACCG TTCCGGCCATAGCAACCATGAGTGGCATGGCCCACACCACGGTGGTCACTGGAACTCAGTGT GACTCCTCAGGGTTGAGGTCCAGCCCTGGCTGAAGGACTGTGAC | SEQ ID NO: 1623 |
| TMEM177 | ADXCRPD.4336.C1_at | TGCCATTGAGTCTGGAGGGCCCTGTTGGAGCCTTTGGACCTATAGCTCAAGGCCAGAAAAT CACTGGCTTTGGAATTAAATAGCTTAGATTGTACTATAACCACTACTTATGAACTCAGGGAC TATGAGGGACTATTCAGGGGCTATGAATCTGAGCCTTTGTTTCTTGAACTGTAAAGTGGAGA TGATGTAAACCGCCTTGCAAGATTGTAGAGTTGGGTAAGGTCATGAACATAAGGGCCTGGCA CAAAGGGTGCACTGTAAATAAACAGACATCCCTCCTTA | SEQ ID NO: 1624 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| NUP210 | ADXCRPD.12713.C1_at | ATCCCTGTTTGTCTGCAGCTTTATATATGAGTTGGGCGACATTAATATTTGTTCTGCTTCTA TTTCAGGGTTGAGCAGCTGCAGCTTCTCAAACACCTGGACTTGGATCTCATCCGAGAGTTCT CTGGCCAGGCCATACAGCTGCCCCGATGTGGGGTCCACAGCCTTGACCACCACCCTCAGCCC GGTCCGGCCTTTTACCCGCCGAGCACGTTCATGGCAAAGTTGTATCTGTGACGGGAGTCGGA TCACGCCTCGTGT | SEQ ID NO: 1628 |
| CD53 | ADXCRPD.3701.C1_at | TGGACCATTGTCACAACCCTCTGTTTCTCTTTGACTAAGTGCCCTGGCTACAGGAATTACAC AGTTCTCTTTCTCCAAAGGGCAAGATCTCATTTCAATTTCTTTATTAGAGGGCCTTATTGAT GTGTTCTAAGTCTTTCCAGAAAAAAACTATCCAGTGATTTATATCCTGATTTCAACCAGTCA CTTAGCTGATAATCACAGTAA | SEQ ID NO: 1629 |
| IQGAP2 | ADXCRPD.12735.C1_at | CCACGCCTGTGTACATGTGGTTTCATAAAACATCCTTAAGCATGAGCTAGACATTAAACAGT CTTGGAGATTCTAGTTCAGAATTTACCTCAAACGTGTGAATTATGGAAATTCATGGTTCATC ACAGATGGTTGGGATGTTGCCAAGATACATCCTTTAGCACGCCTCTGTTTGCTTTATGTGAA CATTAATAACTCTGTTCCAGGAG | SEQ ID NO: 1631 |
| ALDH5A1 | ADXCRPD.14052.C1_at | TTCAGCTGTGATTATTCTGGCAAGGTCATCCTTATTTTGTATCATTAAATTGTACCACTTCC GAAGTAATGAACTCCTCTCCTTGGCGGAGACCTCCCTCCAGCGGCAGAAAGCCTCGTAGGCA GCGCGCACGGCGGCGCGGGCCTCTCGCACCCCACAAACGCCCACCATGCCCAGAGCGGCGCC GCTGGCAGGAGTCTTGCACG | SEQ ID NO: 1636 |
| ALDH5A1 | ADXCRPD.14052.C1_x_at | AGAGAACCACTCTAGGAAAAAGGCGGAATAGAGAATTTCTCCATGTGCCTCCTTCAGTGGCT TCCACTTTCAGCTGTGATTATTCTGGCAAGGTCATCCTTATTTTGTATCATTAAATTGTAC CACTTCCGAAGTAATGAACTCCTCTCCTTGGCGGAGACCTCCCTCCAGCGGCAGAAAGCCTC GTAGGCAGCGCGCACGGCGGCGCGGGCCTCTCGCACCCCACAAACGCCCACCATGCCCAGAG CGGCGCCGCTGGCAGGAGTCTTGCACG | SEQ ID NO: 1637 |
| PTPRCAP | ADXCRPD.5068.C1_at | CCCAACCACAGGCATCAGGCAACCATTTGAAATAAAAC | SEQ ID NO: 1645 |
| PTPRCAP | ADXCRPD.5068.C1_x_at | ACCACAGGCATCAGGCAACCATTTGAAATAAAACTCCTTCAGCCTG | SEQ ID NO: 1646 |
| LBR | ADXCRPD.5090.C1_at | AAACATCAATAGCATTCTTCACAGTACATTTATATTAAGACTGTCTTCTGTTTTCAGGATTA ACGGGTTGAAAATTTCCCATTAAAATGCAAATTCTCACATCCTTACTTGTATTTTTCCTATG TTAACTGTAAGTTAATACAAGTAAACACGGCTATATTAAAAGATCAACTACTCGGCTCCATA GTCCTGACTCAA | SEQ ID NO: 1650 |
| GCN1L1 | ADXCRPD.13574.C1_at | AAGCCTTAGGTTGGTAATCCGGCTGAACTCGGCTTGACGGCCTGAGGCCC | SEQ ID NO: 1664 |
| GCN1L1 | ADXCRPD.13574.C1_s_at | GATGCCCTAAATGCCATCACTAAGAAGCTGGATGCTGGCAACCAGTTGGCACTCATTGAAGA GCTGCACAAGGAAATCCGGCTCATAGGGAACGAGAGCAAAGGCGAGCATGTGCCAGGATTCT GCCTCCCGAAGAAGGGAGTGACCTCCATCCTTCCAGTGTTGCGGGAAGGAGTCCTGACTGGC AGCCCTGAGCAGAAGGAGGAGGCAGCCAAAGCCTTA | SEQ ID NO: 1665 |
| ALDH5A1 | ADXCRPD.13575.C1_at | TTATAACTCTGGATTACCGATGCTGAGATGTGTGCAGGAATACTTCCAAATAAATTTTTAAC ATTGTAAGCCAGTAGATTCTTTGGCTGGGTGGCAAATTTTGAGTCTTCTTGCATATTTGGCT CATGGGTTCATAAATTGAGGCCAGAGACTCATTGTATATCCTTGATCAATTTTCTAATTAAA GGAAATAGCTTATTGTTTAGTAAAATGGCC | SEQ ID NO: 1666 |
| LBR | ADXCRPD.12940.C1_at | GCCAGTTCTTTTACAACGTATGCTTCTTCCTTAGAATCTATTTCTTTTAATCTATGACTTAT TCTCTTCTTGGACGAAGGCTATATCTGTGTTGCTATGTAACTGCTTGACTTGTGACAAAACT GAATTTATCCTGTGTATTTATATGAGGTGCGTCATTTCTCATCAATATGACTCAGGCATCCC CATTAAATCTGACTAGATGCTATTTCACAAATGGCTTCAGAATCAGCGGAGTCAATTTAACT TCCACTTCCCTCCTTGCTTCCTAATGTCGGCCTGATGGTAGCAAGACTGCG | SEQ ID NO: 1673 |
| TMPO | ADXCRPD.12957.C1_at | TAAACATGCAAACTCACTACCAAATTGGCTTATAGTAATATTAGGCCTTAGCAATTCCATTA AATTAAGAGCAACTCATTATTGGAGAACACTTTCTAAGTTGAACTGTAATCATACAAACCGC ACAGCCAAGCAAGTAACTTAAAGACATTGTTGTTAAAATAGTCCATTTTGGATTACCTATCT AAA | SEQ ID NO: 1676 |
| THUMPD1 | ADXCRAD_BP377292_s_at | TGAAAAGTAGCAGCTTCTCTATCCAGGATGATGAGTCAACAGGTTTCACTAATATTTGTCAT GCTGTAGCATTTGTAAGATTTGTAAATGATGAAATTCAAAGAAAACTTTTTCTATTGCTAGG AGCCTGCCAGAACAAAGGCCAATATATAATGTTGTGACATCATATCTGATAACCAGAGGTCT GGTATCTACACTCCTGGTGCCCCATCAGTGGTTGTCTCCATAAGTCATTTTGCGT | SEQ ID NO: 1677 |
| FBXL14 | ADXCRPD.4724.C1_s_at | GGAGGAATAGATGACTTTCTTTCTTTTGGTGGGGGTTGGGACTTGTGGCTTTAAAGAAATCA CTTCTGAGTAGGATGTATATTTTCGTTGGATTTTTGTTGTTATTTCTTTAGAACCCTCCACA GCAACATGCAAGACCATGGAGTTAAAGAAACCCAGAGACCTTTATCAATTAATTGTACTGTT TGTGAAT | SEQ ID NO: 1696 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| UTP3 | ADXCRPD.6075.C1_at | AAAATACTACGTTCTAGCTGCTTAAACAGTCTGTATTTTCCACATTATGATGGATTCAAAGC AAATAAGAGTCACACTTCAAAGTCAGAAGTTGCATTCCTCTTAAAGGATATTTGTACTCGGC TGCTACTATAAGACAAAGGTTAACTTGACAGGCTCAATGTCTCTGTTATATATTGTGGAAAA ATTACCTAAAATAGCTATCATTTATTAAATTTCTATTTTCTGTTAGGTGCTTTACAAATGCC A | SEQ ID NO: 1703 |
| EZH2 | ADXCRPD.13819.C1_at | GTGTTTGACACCGAGAATTTGCTTCAGAGGAGCTCGAAGTTTCATCTTTCTTCTCTTCTTCT TCTTTATCATTGTTCTCTCCCCCGTTTCAGTCCCTGCTTCCCTATCACTGTCTGTATCCTT TGATTCCAGCACATTAATGGTGGGGGTGCTGGGCCTGCTACTGTTATTGGGAAGCCGTCCTC TTCTGCGGCCTCCTGGACGTTTTGGTGGGGTCTTTATCCGCTCAGCGGTGAGAGCAGCAGCA AACTCCTTTGCTCCCTCCAAATGCTGGTAACACTGT | SEQ ID NO: 1705 |
| HNRNPA2B1 | ADXCRAD_C_N402594_s_at | GAAGAAGTGGTCAACCACAGAGTCTTCAAGAAATAAGAAATTCTGTACCATCTGAAAGTAGT TCTTGTTGGTGCCTTCATTTAAA | SEQ ID NO: 1709 |
| LBR | ADXCRPD.13860.C1_at | AATGAAGTGTCTTGGCCAATGGCTTCTCTAATTATTGTTCTGAAACTTTGTGGTTATGTAAT CTTCCGAGGTGCAAATTCTCAGAAAAATGCATTCCGGAAAAATCCCAGTGATCCAAAGCTTG CACATTTAAAAACCATTCATACTTCAACGGGAAAAAATCTTCTAGTTTCTGGATGGTGGGGC TTTGTTCGCCACCCCAATTACTTGGGTGATCTCATCATGGNCTTGGCGTGGTCCCTCCCATG TGGTTTTAACCACATTCTGCCTTAT | SEQ ID NO: 1711 |
| PCCB | ADXCRPD.6197.C1_at | GAATCTCCAAAGAGAATAGCCGGCCCGAAAAGGAG | SEQ ID NO: 1720 |
| PCCB | ADXCRAD_B_P253154_s_at | GCTGCTCAGGCAGAGTACATCGAGAAGTTTGCCAACCCTTTCCCTGCAGCAGTGCGAGGGTT TGTGGATGACATCATCCAACCTTCTTCCACACGTGCCCGAATCTGCTGTGACCTGGATGTCT TGGCCAGCAAGAAGGTACAACGTCCTTGGAGAAAACATGCAAATATTCCATTGTAAACAAAT CAAAGGAAAAGAAACCAAGAACTGAATTACTGTCTGCCCATTCACATCCCATTCCTGCCTTT TGCAATCATGAAA | SEQ ID NO: 1721 |
| IQGAP2 | ADXCRPD.14593.C1_at | CCACTTCTAATGCAATACATATCCCGGAGTGTGCT | SEQ ID NO: 1725 |
| IQGAP2 | ADXCRPD.14593.C1_s_at | GCACTACCAGGATGTTTTATACCATGCTAAATCACAGAAACTCGGAGACTCTGAGAGTGTTT CCAAAGTGCTTTGGCTGGATGAGATACAGCAAGCCGTCGATGAGGCCAACGTGGACGAGGAC AGAGCAAAACAATGGGTTACTCTGGTGGTTGATGTTAATCAGTGTTTGGAAGGAAAAAAATC AAGTGATATTTTGTCTGTATTGAAGTCTTCCACTT | SEQ ID NO: 1726 |
| TPT1 | ADXCRPD.14624.C1_at | CCAGCTGGAGTTTTTGGGACGCTTTTGTGGGGGCACCGCTGAGTCCGGATAGTGGGACCCAA GTCCTCGCTCGGCCCCTGGGGAATAATCGTGTGGGGCGCAAGGTCTGTGGGAAGGGACTT GGAGAGGAGGGAAGATGTCGCGGGAGTCTGCACAGGGTTTCCATGTGTTCCAATTCTTCGTC CCATAATTCAAAGCTCGTGGCATTCTGTGGCCGACCGCTACCGAGCTAGCTCTTCCCTTTAC TATTTCGCACTTGGTCTTGGAAAAGAT | SEQ ID NO: 1733 |
| 41888 | ADXCRPD.5611.C1_x_at | GAAAAACCCTTGTGGGCACCAATGAAATAGGGGGGCTTCGGGAGATTTNNNNNNNNNNAAC ATAAAAAAGAACACGCCCCCCGCGGGGGGCGAAAACGCCCAAGGGCGGCTTTTTCTCAGT AAAACAAAACTCCCCCAAAACGTGGGAAGTTTTCTCTCGGGAGGGCCCTTATTTGACCC GGGGGCGTTCTCTATCCCCAACCACGTGGGCGGAGGCTCCCCTAAGGAGAGCGCGCGTCCTC TCGATAAATATTGCGCGACGACGTGTTTCAGCG | SEQ ID NO: 1734 |
| CALML4 | ADXCRAD_BX431388_s_at | GAAGCAGATATCGAACCCAATGGCAAAGTGAAGTATGATGAATTTATCCACAAGATCACCCT TCCTGGACGGGACTATTGAAGGAGGAGAATGGGAGACCTCCCCTGGGCCTGAAAACTTGGA GCAATTAATTTTTTTAAAAAGTGTTCTTTTCACTTGGGAGAGATGGCAAACACAGTGGCAA GACAACATTACCCAACTATAGAAGAGAGGCTAACTAGCAACAATAATAGATGATTTCAGCCA TGGTATGAGTAGATCTTTAA | SEQ ID NO: 1753 |
| ATHL1 | ADXCRAD_AJ708476_s_at | AGTGGGATGGCTCTCTTCCCTCAGCCACGCCGCTTGTGAGGACAGAGGTGGGGAGTGGGAA GTGGGAAGTCACCAGAGAACAGGAGAGGGATTTGAGGGCGCGACCCCAGCGCTCTCCACGGA CCAGCCAGAGGGACTGGAGCCAGGTGTGCATGGGTTCAAGGCCCTGGCCCTGCCCAGCCTCT GTCTTGGGAGCTCAGCCCCAGGGTTCGGTCGTCAGCAGTTTCCCAAGAACAAGATGTGATGG CATCTGCTGCTGAAACCCTGATGAGGACCAGGCCCC | SEQ ID NO: 1756 |
| LRMP | ADXCRPD.6445.C1_at | AGTCTGCCTATGATCTTTGAATGAGCTTTTTAAGGAAGAATATTATATATTGTTTGCTAAAG CCTATTGAAATAAAG | SEQ ID NO: 1757 |
| BCL11A | ADXCRPD.15478.C1_at | CCATCCCACCACATCATGTAAAGTGTTCTAGGCTTCTCTATATAATACCCAGAAATGTGAG CATACAAAAAGTACAAGGATGTGAAGGTTATCAACCAGAGAGCAAATTGGTCAATGAGGCAA ATCATCACATATGTAAAGAAAACAGTCTTCCTGGCATAACTCCAGAGAACACACACACACAT ATACCCATGCACACACCCACAGCAACAAATGTGTCTGGTCTGGTAAGTTTA | SEQ ID NO: 1758 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| HCLS1 | ADXCRPD.6475.C1_s_at | GTCCTCTCTATCCTGGATGAGCTCATGAACATTTCTCTTGTGTTCCTGACTCCTTCCCAATG<br>AACACCTCTCTGCCACCCCAAGCTCTGCTCTCCTCCTCTGTGAGCTCTGGGCTTCCCAGTTT<br>GTTTACC<br><br>CGGGAAAGTACGTCTAGATTGTGTGGTTTGCCTCATTGTGCTATTTGCCCACTTTCCTTCCC<br>TGAAGAAATATCTGTGAACCTTCTTTCTG | SEQ ID NO: 1760 |
| WDR59 | ADXCRPD.15558.C1_s_at | CAGTGTTACCCTGTAAGGTGTTAGCCTTAAACCACCGAGCAGCGTTCTCTTGATGCCAGTGC<br>AGAGACCAGAGTCAGATGCCCGAGGACAGTGGGTAGGAATTTCATCAACAAATGGACCTATG<br>GCATCATGGCTTTAGAAGCTGGTACATTTACTGAGCTGATGACAGTGGCCTTCTAAAATAT<br>GACACTTAAATTGTAAATATGCACTGTACTTAAGGATTCTTAAGATGTATTTTTTTGTTATT<br>TCTCCTCCAGCTGCTATCCCTTGGCTAATAAA | SEQ ID NO: 1764 |
| ATP2A3 | ADXCRPD.5908.C1_at | ACATATAAAATCATCAGTCTGCACACGCTCTAGGAGGGGCCAAGACATAGGGACAATCCTTG<br>GTGCAGGTTTCTGCTACCCCTCGCTAGTTTTTGCCAAAGTAGCAAAAGCTGAGTTAAGAGAA<br>AAATTCTGTCCATCAGAGGCCATCTTCCTCTCATCTGATATGACGTGTTCCTCCAGCAGGGA<br>GGGAGGGAGAGCGGGTGCCCTGGGGAATCAGCCATCCTTAGTGACATCCTTTCGGCTCATGG<br>GTGTCGTG | SEQ ID NO: 1765 |
| CHD7 | ADXCRPD.14939.C1_at | TGCTGGTGCATTAGTCCTTGACCACTGTTTGATGGGAATCCTACAGCATTGGGGTATCTTGG<br>TACGGACTGATTCATTGGAGTATTATTTGTAAGGCCTAAATTTTGATTCATCCCTGTATTGT<br>TAACTAATCCCTGATTTAGGTTACTGTAAGGATATCGAGAATACTGCCCTGAGTTGTTTATA<br>GTAGGAGAGGGGACTGTCTGGCTCCGAGAACTAAAGTTAAGGGTTTGCGGCCTAACAGCCCC<br>TTGTTGGGGAGGATTCGGGGAGAATCTGGGACTGTGGGCAACGGATTC | SEQ ID NO: 1766 |
| NUP210 | ADXCRPD.7334.C1_at | ACTGAAGTCTGTTCACAGTGGCCCATGGTTGGGCAGCAGCCCTGGGTGAGCTCCTGTGTTCT<br>CCAGCCTCTCGCTCACCCAGGGCTTGGCTATCCTGGCCTCCAGGTGCTGGTTCCTGAGGCTT<br>CCCTTGCGGCAGTGGCGCAGATACAGGGACACTCATGTCCCATTGCTCCTCAGAAGTCCTAG<br>CAGCCAGACTAG | SEQ ID NO: 1781 |
| SKAP1 | ADXCRPD.16383.C1_at | CAGAAGTTCCAGACCCGGTGGACCACCTGGTGAGACCCCTGTCTCTTTAAAAGNNNNNNNNNN<br>NNNNGGAAGACAATTTATTTTAAAAACATCTGAGAATCATTACTGCTTTTATAATATTTAAA<br>TTTTCTACATGAATTAAATAGCCAAGTACATAGTTATCTATCATTCATCTATCCAGTAAAA<br>TGTTATGTATTTATGATGCACCAGCATTATAACTAACTCTGAGATCAG | SEQ ID NO: 1782 |
| MDN1 | ADXCRPD.16426.C1_s_at | GAAAGAAGCCGAGAGTCTACCATTCATACAGCTCATCAATTCCTCATGGACACGATCTTCCA<br>GCCCTTTTTAAAAGATGTCAATGAGCTAAGACAGGAGCTGGAGAGACAGCTGGAAATGTGGC<br>AGCCACGTGAATCTGGAAACCCAGAGGAGGAGAAGGTTGGAGCTGAGATGTGGCAGAGTTAC<br>CTGATCTTAACAGCGCCTCTTTCAAAACGGTTATGTGAAGAGCTTCGTCTCATATTAGAGC | SEQ ID NO: 1793 |
| USP7 | ADXCRPD.16454.C1_at | GTCTGTCTGGATAAAAGCGTGGCATCACCATAATCTTCCATGGCAGATTTCGCACAAAACAC<br>GGAGGGCTAAGGACCGACTCACTCAGTCTGCTGAAGCGCTCCACAGTGAACTGAAAGGCTGC<br>CTCGGAGCGCCAACTGGTGTCATCCTCCATGTCCTCCTCCGCGGTGTTGTGTCCATCACTCA<br>GGGCCACATTCCCATTGATCACAGGGTTCTGAGTAATTCTTGGTGGCTCATCATGTATCTCC<br>CG | SEQ ID NO: 1794 |
| NUP210 | ADXCRPD.15803.C1_at | ACCTTACTCCCACGATCACTTACAACCCCACGATCACATACACCTTCATCTCACCGAAATGG<br>AGTGGGTTCTGCACATCATGTGCCCGGATCACACTGAACCCGATGTCACTGCCTGTGGTCAT<br>CACGCCCTTGACAGTAACTGTGGCAACCAGGTGGCTTGACGAAGACCAGCTGAAGTTCCCAC<br>TGCCACCGTGGGCCCTTATTGTGTACTGATAGGCGCCCGTCTTTGGTTGCCACGGAAATGTC<br>AAGATGCTGGGATACAGGGT | SEQ ID NO: 1795 |
| NUP210 | ADXCRPD.15803.C1_s_at | CACCTTCATCTCACCGAAATGGAGTGGGTTCTGCACATCATGTGCCCGGATCACACTGAACC<br>CGATGTCACTGCCTGTGGTCATCACGCCCTTGACAGTAACTGTGGCAACCAGGTGGCTTGAC<br>GAAGACCAGCTGAAGTTCCCACTGCCACCGTG | SEQ ID NO: 1796 |
| TFB1M | ADXCRPD.7488.C1_at | GTGATGAAGACCCACAACTCTTTGCATATAATTTCAGAGAAGAACTCAAGCGAAGAAAAAGC<br>AAAAATGAAGAAAAGAAGAGGATGACGCAGAGAATTACAGACTCTAGCTGCTGCCTGGGGG<br>CGAGCAGCCTACCAGATGTCGATTTGCACTACGTGGAGCTTCTTATATAGGTACTCTTTTGT<br>CTTTACAGAATGACGATACAAATGCCAATGACCAGATGTGACTTATTTTCCTTTTACTATAC<br>AGCTTGGCAG | SEQ ID NO: 1800 |
| TAPBPL | ADXCRPD.6849.C1_s_at | TTCAGAGACGGCAAGCACCTACAGGACTTGGGCTGCTTCAGGCTGAACGCTGGGAGACCACT<br>TCCTGTGCTGACACACAGAGCTCCCATCTCCATGAAGACCGCACAGCGCGTGTAAGCCAGCC<br>CAGCTGACCTAAAGCGACATGAGACTACTAGAAAGAAACGACACC | SEQ ID NO: 1803 |
| MYC | ADXCRPD.8111.C1_at | CAGTGTCCGTCTCCGGCTGTCAGAAATGCGGTGAGCCGAAATTTAAATGCCCTCCCGGAGAC<br>GGGGACAAGTCAGCGGCTGCGGAGCGATCTGGCTCACACAGGCGATATGCGGTCCCTACTCC<br>AAGGAGCTCAGGATGCAAGGGCTTTCTGCCCACCCGAAAGCAACCCCCAGCCCCCAAAAC<br>CCAGAGAGCAATTAACACAATAAAGCAGGAATGTCCGACCGGCCGGGAGTCAGCGTGAATAT<br>ATTCATAAGGCAGAAATCTCGAAAGGGTAGTCTT | SEQ ID NO: 1806 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| NUP210 | ADXCRPD.15917.C1_at | GCCTGACAGGTCACAAGGATCCAGTGTTGCTGATAATTCCGGGAGGAATGGGGGGCAAAGAG AGCCAGGCCGATGCTGTCAGTGTCCTCAGCGGCGACGTTCTGGAAGAATTAGGACGGCTCGA GGATCCAAGGTCTGGGACCTCCTTCAAACAGCATCTCCTTTGAGGAGCCCAGGGTTACCAAG GCAACAGAGGAGGGATCCACAGCCTTGAGGGGCAGGTAGGCAGCAATGGTGATCTTGGCACT CAGGTGGACGTGGCCGTGTCTGTAGCTCACAAGACGCGTGGTA | SEQ ID NO: 1813 |
| CXCR4 | ADXCRPD.7562.C1_s_at | GTATGTCTCGTGGTAGGACTGTAGAAAAGGGAACTGAACATTCCAGAGCGTGTAGTGAATCA CGTAAAGCTAGAAATGATCCCCAGCTGTTTATGCATAGATAATCTCTCCATTCCCGTGGAAC GTTTTTCCTGTTCTTAAGACGTGATTTTGCTGTAGAAGATGGCACTTATAACCAAAGCCCAA AGTGGTATAGAAATGCTGGTTTTTCAGTTTTCAGGAGTGGGTTGATTTCAGCACCTACAGTG TACAGTCTTGTA | SEQ ID NO: 1814 |
| LGALS9 | ADXCRPD.6993.C1_at | AAGATGAAGCCCCATGCTCAGTCCCCTCCCATCCCCCACGCAGCTCCACCCCAGTCCCAAGC CACCAGCTGTCTGCTCCTGGTGGGAGGTGGCCTCCTCAGCCCCTCCTCTCTGACCTTTAACC TCACTCTCACCTTGCACCGTGCACCAACCCTTCACCCCTCCTGGAAAGCAGGCCTGATGGCT TCCCACTGGCCTCCACCACCTGACCAGAGTGTTCTCTTCAGAGGACTGGCTCCTTTCCCAGT GTCCTTAAAATAAAGAAATGAAATGCTTGTTGGCACAAAAA | SEQ ID NO: 1820 |
| LGALS9 | ADXCRPD.6993.C1_x_at | AAGATGAAGCCCCATGCTCAGTCCCCTCCCATCCCCCACGCAGCTCCACCCCAGTCCCAAGC CACCAGCTGTCTGCTCCTGGTGGGAGGTGGCCTCCTCAGCCCCTCCTCTCTGACCTTTAACC TCACTCTCACCTTGCACCGTGCACCAACCCTTCACCCCTCCTGGAAAGCAGGCCTGATGGCT TCCCACTGGCCTCCACCACCTGACCAGAGTGTTCTCTTCAGAGGACTGGCTCCTTTCCCAGT GTCCTTAAAATAAAGAAATGAAATGCTTGTTGGCACAAA | SEQ ID NO: 1821 |
| PPRC1 | ADXCRPD.16668.C1_at | AGGGCTTCACTGCAGAGCTGTCTTCTTGGCTGGGGCTGGTGGGATGACAAGACAAGGGATGT CTGCCAGCCCTGTGGGAGTCTCTGGAAGGCTAGGCCACTTCCCAGTTGGGGGCTGTGGACTT CTCTCTTCTGTTTCTGCTTGGCGTTGCTGCCTTCGTCGCCGGTACTCAGATAAGCTGAGAGG CCGAGGTCTGGCTTCATGGGTTGTAGCACTGGTACCACTTTCAATTTTCA | SEQ ID NO: 1832 |
| ALDH5A1 | ADXCRPD.1124.C1_at | TAAATTTCTTACCACACTCATTCCCAAGTTTTATCCCACAAAGTATAGCATGAAACAATGAC AACATACATATTATTCAAGTAAAATGCTATTTAAAATAGCTGCACACAGGTAATTAAAACAC CTAGGATCCAGTTTTTAGAGGAAAAAGNCATGTGGCACAATTNCAAGTTCATAAATTGAGTT AACAGTAAAACAGATTTGCTCACATTTGCTTCTGATCTTTAT | SEQ ID NO: 1865 |
| MFNG | ADXCRPD.17460.C1_x_at | TGGCAATTGGCACTGAAGGCACCCAAGCCCCTGGAGCCTTTCTTGCGGTTAGGGCTAACATG GACGCTTTGGCAGAGGAACTAAGCAATCCAATAAGATGTTCTTGGAAAGTTTTGAGCCAC TCCCATCTTCTGGCAAAATGTGGGTTGAAGGCGGATCT | SEQ ID NO: 1873 |
| NUP210 | ADXCRPD.9121.C1_at | TGCCTTGCATATTACTTGAGCTTAAACTGACAACCTGGATGTAAATAGGAGCCTTTCTA | SEQ ID NO: 1884 |
| NUP210 | ADXCRAD_CX756211_s_at | TTGGAAAAGTCCTCTCTTCCCAGCTCCTGATTCTGGATCTGAGATTCTCAGATCACAGGCCC CTGTGCTCCAGGCCGAGGCTGGGCCACCCTCAGGGAGATCCAGAGACTCATGCCCATGGCCA TCCATGCGTGGACGCTGTGTGGAGAGTCCAGGATGACGGGATCCCGCACAAGCTCCCTTCAG TCCTTCAG | SEQ ID NO: 1885 |
| EWSR1 | ADXCRPD.18189.C1_x_at | AATGGGAACCCCTTGTGAGCATGCTCAGTATCATTGTGGAGAACCAAGAGGGCCTCTTAACT GTAACAATGTTCATGGTTGTGATG | SEQ ID NO: 1890 |
| UBE2L6 | ADXCRPD.250.C1_at | TGCCCTTAACCCGATTTGGCCATTCCCCTCTCTCCCCCGTACTATACACCCCCGCCCCGCCT TCCTTCCCGCCTTTGTGCGCCTGTCCGATCATANTTTCCGCCCATGGTCCACGTTCTCCGCC GCGTAACCTATATCCTGGATTCTCTTCCCGCCCCGCGTGTGCTACCCCCTTATTGCCATTTT CCCGTTACGCGGAGTTCGCCCGAGGCCCGGGGCTTTGTCGCCGCGTACTTTAGGCCCCGCCC CGCCTAAGTTCCGCCTTCATTATACCGCGCTGTG | SEQ ID NO: 1893 |
| REPIN1 | ADXCRPD.869.C1_at | ACATCTGCCGCTAACCGTGAAACACCACCACCCGTGGTTCGCCCCAGTTCGCCACCTCCCGC CCTTTTGCCTCCACGCGCTGTACCCACGCCGTGTGGCGGAACAAACCTCGCCGACATTGACA CAAAGTGCCTCCCTCTTGTTGATCNCTCCCACGCGCCGGACAAACTAGCCTCGCCCCCAGTG AACATCCAGGCCCCGCAGGGCGGATCATGGACCATATACCTTCTCTGCATCACCGGCCTCCC TATAGACACACACTCCCGCTCTGCTGAGTGATATACACGCCCGCCAGGG | SEQ ID NO: 1901 |
| NAP1L1 | ADXCRPD.367.C1_s_at | AGTGAAGTTCTCAGATGCTGGCCAGCCTATGAGTTTTGTCTTAGAATTTCACTTTGAACCCA ATGAATATTTTACAAATGAAGTGCTGACAAAGACATACAGGATGAGGTCAGAACCAGATGAT TCTGATCCCTTTTCTTTTGATGGACCAGAAATTATGGGTTGTAC | SEQ ID NO: 1910 |
| PIM2 | ADXCRPD.11037.C1_at | GCTGGGAAGTGGAGCTCAGCTTCCAGAATCTCCTGGTCCCTCTCAAAGGGAATGTCCCCACA CACCATGTCATAGAGGAGGATGCCCAGTGACCAGACAGTGGCCGGGAGTGCATGGTACTGGT GTCGAGAGATCCACTCTGGGGGCTGTACACCCTTGTCCCATCAAAGTCAGTGTAGGGTTCA TCATGAAGCAGGGCACCAGAACCAAAATCAATGAGTTTGGCACAGCCACGGCGTAGGTCTAT CAGGATGTTCTCAT | SEQ ID NO: 1912 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| TOP1 | ADXCRPD.5549.C2_at | AGAAGAGCGCTATCCTGAAGGCATCAAGTGGAAATTCCTAGAACATAAAGGTCCAGTATTTG CCCCACCATATGAGCCTCTTCCAGAGAATGTCAAGTTTTATTATGATGGTAAAGTCATGAAG CTGAGCCCCAAAGCAGAGGAAGTAGCTACGTTCTTTGCAAAAATGCTCGACCATGAATATAC TACCAAGGAAATATTTAGGAAAAATTTCTTTACAAGACTGGAGAAAGGAAATGACTAATGAA GAGAAGAATATTATCACCACCTAAGCAATGTGATTTAACCAGA | SEQ ID NO: 1913 |
| USP7 | ADXCRPD.949.C1_s_at | CTGCAAGTGAATTTCACTGATGTTGATATTCATTGTGTGTAGTTTTATTTCGGTCCCAGCCC CGTTTCCTTTTATTTTGGAGCTAATGCCAGCTGCGTGTCTAGTTTTGAGTGCAGTAAAATAG AATCAGCAAATCACTCTTATTTTTCATCCTTTTCCGGTATTTTTTGGGTTGTTTCTGTGGGA GCAGTGTACACCAACTCTTCCTGTATATTGCCTT | SEQ ID NO: 1919 |
| ANP32A | ADXCRPD.232.C2_s_at | AGCTTCATTTTTGTTACCTGATAGAATAGCTTTTCTTATGAGATATATATAATGTGATACTA TGTTTGGATATTTTTGGTCTTAAAGCAAGACTCAGTGGTGTATCTTCATTAAAAGCTTCCTT TAAAAAAGTTACAGAGTTACTAAAAAAACAAGTACCCAAACAATCAAGTTGGGCCAACCTTG GAACCTTGTTTTGAATATCTTTCATTGTTTTGTTTGTCGTATTGTAAAAAGAATGTATGGTT GAAAACTCAGGAA | SEQ ID NO: 1921 |
| AQP3 | ADXCRPDRC.2086.C1_at | GCCCCAGCCTTAGGTTTGGAGCTCTGGATGACATACATAAGTAGGAGCAGTGGGAACTGTTT CTGTCATAATGAAGGCTGAAAGCGTGGAGTGAACTCAGGTCCTACAGTTCATGGGTGGCTT TTGGTTGGTCCTGGCCTTTACGGGAAGGAAGCAAAGCTATACCGCCCTAAGGGA | SEQ ID NO: 1926 |
| TAPBPL | ADXCRPDRC.18421.C1_at | TCCAGATGACTGAGACCACGTGTTCAGACAGCAGCGTTGGTTCACTGGCCAACGTGCAGGTC TCTGGAGGGGGACCTAGCTTCTCCTTGTGTGATGAACGACTCCCAGGGTCGCCAAGAATGAG GCGCTCTGGCACCCGACCGCTGAACTTGCCACTTGAGGCCCCAGGGAGACTGTGCGAACTTG CAGTGAAGTTCCAGGTGATGACACATGACCAATCACTGAGACTCCTGCTGGGGTCCTCAGTC TCCTTGGACCTGTGGGTTCTCCATGGACACGG | SEQ ID NO: 1934 |
| NFATC3 | ADXCRPDRC.9584.C1_at | GGATACTTTTATATGATGGGTGCTTTGAGTGTGAATGCAGCAGGCTCTCTTGTTTCCGAGGT GCTGCTTTTGCAGGTGACCTGGTTACTTAGCTAGGATTGGTGATTGTACTGCTTTATGG | SEQ ID NO: 1939 |
| USP7 | ADXCRPDRC.11382.C1_at | AAGTATTTCTTGAGCCCAATTGTGGACGTTCAGTTAGGGGTGGCAGTTAACGCTGACCTCTG CAGTTGCGTTGGTGGAAATCACCCAGCTGGGATCCATGCGCGTCATTCCCAGACTCAGTGGG GTGTGCCTCCATTGCAAAGACAGTTGCACAGAAGCTCAACACAGACCCATTGTTGCTCCAGT TTTTCAAGTCTCAGGGGTAACCCTCAAGCCGCTGTGGTGCAGAGGGTTATGCGTGTTTCACA ATTAAGCCGCGACA | SEQ ID NO: 1940 |
| 41888 | ADXCRPDRC.2412.C1_at | GATGTCTGGCCCGCTGGGTCAAGAAGCCAACAAGTCATGTTGGCTCGGCAGAATGCATCCCT GGC | SEQ ID NO: 1943 |
| 41888 | ADXCRPDRC.2412.C1_x_at | AGGGTCCTGTTTGTGCTTCCTGTAGACACCCTTTTCCTGCGCAACAGAGCTGGGCCTCCCTT TCTCTAATTTCCCCCTTAACATGCCTGGGGGCATACAATCCAACCCGTGCCCTCTCCTCTC TTCCTGCCAAGGTTTATAGAAACCTGAGAATCGAGGGTGATGTCTGGCCCGCTGGGTCAAG AAGCCAACAAGTCATGTTGGCTCGGCAGAATGCATCCCTGGCATTCCCAGGT | SEQ ID NO: 1944 |
| ARHGAP15 | ADXCRPDRC.9769.C1_s_at | TACCCTTCTGCGAGCTGAAAATGAAACAGGAAACATGGCGATCCACATGGTCTACCAGAACC AGATAGCTGAGCTCATGCTGAGTGAGTACGTAAGACTCTTCGGCTCAGAGGAAGACTGACAG ACAAGCAAGCTACTGAATACGTTCACATCTGTCTTGATGCCTAATATTTTTACATTTCTGT AAACATATTTCTGAAATATTTTTTGCCTTTCAAGCGACAGATGCCTCATTTTGTGAA | SEQ ID NO: 1952 |
| ALDH5A1 | ADXCRPDRC.1911.C1_at | GAAAGCAATGGTGAGCAATCTGGTTTACTGGTAACTTCAATATGAACTGTGAATGTGCCACA TGACTTTTTCCTCTAAAACTGGAATCCTAGGGTTTTAATTTACTGGNGTGCAGCTATTTTAA ATAGCATTTACTTGGAGAAAAAAAGGNAGGTTGGGCATTGTTTCATGGCTAAACTTT | SEQ ID NO: 1957 |
| ALDH5A1 | ADXCRPDRC.1911.C1_x_at | GAGCTGATCTGCATCTGTTTATCCATTTTAGTAGCTTTTAAATATGATTTTATGTGAAGTGC CATTTTTCTTATCTACTAAAGAGAGACAGCAGAAATAAAGATCNGAAAGCAATGGTGAGCAA TCTGGTTTACTGGTAACTTCAATATGAACTGTGAATGTGCCACATGACTTTTTCCTCTAAAA CTGGAATCCTAGGGTTTTAATTTACTGGNGTGCAGCTATTTTAAATAGCATTTACTTGGAGA AAAAAAGGNAGGTTGGGCATTGTTTCATGGCTAAACTTT | SEQ ID NO: 1958 |
| IGJ | ADXCRPDRC.2619.C1_at | ACAGAGACCTGCTACACTTATGACAGAAACAAGTGCTACACAGCTGTGGTCCCACTCGTATA TGGTGGTGAGACCAAAATGGTGGAAACAGCCTTAACCCCAGATGCCTGCTATCCTGACTAAT TTAAGTCATTGCTGACTGCATAGCTCTTTTTCTTGAGAGGCTCTCCATTTTGATTCAGAAAG TTAGCATATTTGTTACCAATGAATTTNGAACCAGGGCNNNNNNNNNNNNNNGGGGGATGTAA AACAACTCCCTGCCACCAAAATAATTA | SEQ ID NO: 1962 |
| IGJ | ADXCRPDRC.4305.C1_at | ATATTTGGACATAACAGACTTGGAAGCAGATGATACAGACTTCTTTTTTTCATAATCAGGTT AGTGTAAGAAATTGCCATTTGAAACAATCCATTTTGTAACTGAACCTTATGAAATATATGTA TTTCATGGTACGTATTCTCTAGCACAGTCTGAGCAA | SEQ ID NO: 1974 |
| NUP210 | ADXCRPDRC.12713.C1_s_at | ATTGTTGCTGTAAAGGTATCCCCTGTTTCCTACCTGAGGGTTTCCATGAGCCCTGTACTGCA CACCCAGAACAAGGAGGCCCTGGTGGCCGTGCCTTTGGGAATGACCGTGACCTTCACTGTCC ACTTCCACGACAACTCTGGAGATGTCTTCCATGCTCACAGTTCGGTCCTCAACTTTGCCACT | SEQ ID NO: 1976 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| | | AACAGAGACGACTTTGTGCAGATCGGGAAGGGCCCCACCAACAACACCTGTGTTGTCCGCAC AGTCAGCGTGGGCCTGACACTGCTCCGTGTGTG | |
| ALDH5A1 | ADXCRPDRC.14052.C1_s_at | AAAGCCACTGAAGGAGGCACATGGAGAAATTCTCTATTCCGCCTTTTTCCTAGAGTGGTTCT CTGAGGAAGCCCGCCGTGTTTACGGAGACATTATCTACACCCCGGCAAAGGACAGGCGGGCC CTGGTCCTCAAGCAGCCCATAGGCGTGGGCTGCAGTCATCACCCCGTGGAATTTCCCCAGTG CCATGATCACCCGGAAGGTGGGGGCCGCCCTGGCAGCCGGCTGTACTGTCGTGGTGAAG | SEQ ID NO: 1978 |
| LBR | ADXCRPDRC.5090.C1_s_at | TTTTTGTAATATATGGTGACTTCAGATTTTTTTGTACAGTATTTTGAATGTGAGATGATTGT CAGGACTAACTGTCTTTTTAACAAAACATTTTCAGTATTTTAAATAAAATTTTGTAAAGTAA TGTGAATTAAAAATTTTGGAACAATTAGAATTCATTCACTATTGTATAGAAGATGCTGTTAA AACATAGGAAGGGTATTTTTCTTGATCCAAAGTTTGTGAATTTGGCTTTGCTACCTCAATTG CAGGTGTTTGTT | SEQ ID NO: 1982 |
| ATP2A3 | ADXCRPDRC.4511.C1_at | TCCTGAGCTCGGGAGATGTTCAGAGTCACACTGCCGCCCGGTCTGCCACGCAGAGGTCCAAC TTGCCACCCGCGTCCCTGGTACCTGAGACCACCGACATCCTCAGGTTCCTGACCGTGGCGCC CTTCTACCCAGCC | SEQ ID NO: 1988 |
| ATP2A3 | ADXCRPDRC.4511.C1_s_at | GTCAGAGACGGACACAAGGAGCCGGCAGGAGGGCGGAGCGAGGATGTCCTTTCCCGGGAG ACAAGTCGGGAAAGCCTGGCTGGACTGCCTCAGCCCCGCGCGCCTCCTGGACTCAGGGTTCC CCGTCCTGAGCTCGGGAGATGTTCAGAGTCACACTGCCGCCCGGTCTGCCACGCAGAGGTCC AACTTGCCACCCGCGTCCCTGGTACCTGAGACCACCGACATCCTCAGGTTCCT | SEQ ID NO: 1989 |
| ATP2A3 | ADXCRPDRC.4511.C1_x_at | AGGATGTCCTTTCCCGGGAGACAAGTCGGGAAAGCCTGGCTGGACTGCCTCAGCCCCGCGCG CCTCCTGGACTCAGGGTTCCCCGTCCTGAGCTCGGGAGATGTTCAGAGTCACACTGCCGCCC GGTCTGCCACGCAGAGGTCCAACTTGCCACCCGCGTCCCTGGTACCTGAGACCACCGACATC CTCAGGTTCCTGACCGTGGCGCCCTTCTA | SEQ ID NO: 1990 |
| LBR | ADXCRPDRC.12940.C1_at | CCATCCGGGCAAAGGACTTGGAGTTTGGAGGAGTACCTGGTGTGTTTCTCATCATGTTTGGC CTGCCTGTGTTCCTCTTCCTGTTGCTGTTGATGTGTAAACAGAAAGATCCCAGTCTTCTGAA TTTCCCTCCTCCTTTGCCAGCTTTGTATGAGTTATGGGAAACCAGAGTATTTGGGGTCTACC TCCTGTGGTTTCTGATTCAAGTCCTGTTCTACCTACTGCCAATTTGGAAAGGTTGTAGAGAC GCCTCTTACTGATGGGAGCAGA | SEQ ID NO: 1996 |
| EZH2 | ADXCRPDRC.13819.C1_s_at | AAGATGAAACTTCGAGCTCCTCTGAAGCAAATTCTCGGTGTCAAACACCAATAAAGATGAAG CCAAATATTGAACCTCCTGAGAATGTGGAGTGGAGTGGTGCTGAAGCCTCAATGTTTAGAGT CCTCATTGGCACTTACTATGACAATTTCTGTGCCATTGCTAGGTTAATTGGGACCAAAACAT GTAGACAGGTGTATGAGTTTAGAGTCAAANGAATCTAGCATCATAGCTCCAGCTCCCGCTGA GGATGTGGATAC | SEQ ID NO: 2004 |
| TPT1 | ADXCRPDRC.14624.C1_at | TTATGGGACGAAGAATTGGAACACATGGAAACCCTGTGCAGACTCCCGCGACATCTTCCCTC CTCTCCAAGTCCCTTCCCACAGACCTTGCGCCCCACACGATTATTCCCCAGGGGCCGAGCAG GACGACTTGGGTCCCACTATCCGGACTCAGCGGTGCCCCCACAAAAGCGTCCCAAAAACTCC AGCTGGGGCAGCCCTGGGGCCGATGCTGAAAAGTTGTCAGAGGGCCCTCGGGCAGTCCCGAGA TCTACCCCAGGCCAGAGGGCCTGACCCTCCCTAAATGCGACGTTCT | SEQ ID NO: 2009 |
| ATP2A3 | ADXCRPDRC.5908.C1_at | ACAACGTGTCGTGCGCGCACCGAAGCCTTACGACCCCGACGGGCGGTGGGGACACCTATCAG GAAACAAAAAACGGCAGGCACCGCTGCTAGGCCCCGCAAGGAGAGAAACAACACGAACAGCGA GTGATGCCCCACTAAATGGCTCGCTTTTAATGACGGAACAAGCCGTCTGCGCCCCAGAACCG CGAGTGCTCACCGGAATAGAATCCGCACCAGCGCTAGGT | SEQ ID NO: 2015 |
| CHD7 | ADXCRPDRC.14939.C1_s_at | TCCAATGAATCAGTCCGTACCAAGATACCCCAATGCTGTAGGATTCCCATCAAACAGTGGTC AAGGACTAATGCACCAGCAGCCCATCCACCCCAGTGGCTCACTTAACCAAATGAACACACAA ACTATGCATCCTTCACAGCCTCAGGGAACTTATGCCTCTCCACCTCCCATGTCACCCATGAA AGCAATGAGTAATCCAGCAGGCACTCCTC | SEQ ID NO: 2016 |
| USP7 | ADXCRPDRC.16454.C1_at | GGGATTTCCAATATTATGGGCATGGAGTAAATGGC | SEQ ID NO: 2022 |
| USP7 | ADXCRPDRC.16454.C1_s_at | GACTGAGTGAGTCGGTCCTTAGCCCTCCGTGTTTTGTGCGAAATCTGCCATGGAAGATTATG GTGATGCCACGCTTTTATCCAGACAGACCACACCAAAAAAGCGTAGGGATTCTTTCTCCAGT GCAATGCTGAATCTGATTCCACGTCATGGTCTTGCGAATGCACAAGCAGTGCTGAAGATAAT AACTTACAGAGATGATGAAAAGTCGTTCAGTCGTCGTATTAGTCATTTGTTCTTCCA | SEQ ID NO: 2023 |
| NUP210 | ADXCRPDRC.15803.C1_at | GTGGGGTTGTAAGTGATCGTGGGAGTAAGGTCCGAG | SEQ ID NO: 2024 |
| NUP210 | ADXCRPDRC.15803.C1_s_at | AGCATCTTGACATTTCCGTGGCAACCAAAGACGGGCGCCTATCAGTACACAATAAGGGCCCA CGGTGGCAGTGGGAACTTCAGCTGGTCTTCGTCAAGCCACCTGGTTGCCACAGTTACTGTCA AGGGCGTGATGACCACAGGCAGTGACATCGGGTTCAGTGTGATCCGGGCACATGATGTGCAG AACCCACTCCATTTCGGTGAGATGA | SEQ ID NO: 2025 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| NUP210 | ADXCRPDRC.15917.C1_s_at | TCTGTTGCCTTGGTAACCCTGGGCTCCTCAAAGGAGATGCTGTTTGAAGGAGGTCCCAGACC TTGGATCCTCGAGCCGTCCTAATTCTTCCAGAACGTCGCCGCTGAGGACACTGACAGCATCG GCCTGGCTCTCTTTGCCCCCCATTCCTCCCGGAATTATCAGCAACACTGGATCCTTGTGACC TGTCAGGCCTTGGGTGAGCAGGTCATCGCCCTGTCGGT | SEQ ID NO: 2028 |
| PPRC1 | ADXCRPDRC.16668.C1_at | GAAGAGAGAAGTCCACAGCCCCCAACTGGGAAGTGGCCTAGCCTTCCAGAGACTCCCACAGG GCTGGCAGACATCCCTTGTCTTGTCATCCCACCAGCCCCAGCCAAGAAGACAGCTCTGCAGT GAAGCCCTGAAACACCCCTTGAGATTTGCCTTGTGCCTATAGGTCCCAGCCCTGCTTCTCCT AGTCCTGAGCCACCTGTAAGCAAACCTGTGCCTCATCTCCCACTGAGCAGGTGCCATCCCAG AAGATGCCACTGTTGGCGAGACCTT | SEQ ID NO: 2033 |
| ALDH5A1 | ADXCRPDRC.1124.C1_s_at | GTGTTTTAATTACCTGTGTGCAGCTATTTTAAATAGCATTTTACTTGAATAATATGTATGTT GTCATTGTTTCATGCTATACTTTGTGGGATAAAACTTGGGAATGAGTGTGGTAAGAAATTTA TAAAGTTTTGCTTTTAAAACGTGGACATAACTCAT | SEQ ID NO: 2038 |
| ALDH5A1 | ADXCRPDRC.1124.C1_x_at | TCCTCTAAAAACTGGATCCTAGGTGTTTTAATTACCTGTGTGCAGCTATTTTAAATAGCATT TTACTTGAATAATATGTATGTTGTCATTGTTTCATGCTATACTTTGTGGGATAAAACTTGGG AATGAGTGTGGTAAGAAATTTATAAAGTTTTGCTTTTAAAACGTGGACATAACTCATTTTTC TAGTTTTTTGACAATTGTGTGTTTTAGTGTCTAGTCTGCAGAGAGCTGTGTGATTAATAAACG TGGAATTAACAGAATTTCCTCTCCCTGTAA | SEQ ID NO: 2039 |
| MFNG | ADXCRPDRC.7895.C1_s_at | AACCCAAGGGCGCTGCTGCAGCTTCTGAGAGCCTTCCCGCTGGCCCGCGACGTCTATGTGGG AAGGGCCAGCCTGAACCGGCCCATCCATGCCTCAGAGCCACAGCCCCACAACCGCACGAGGC TGGTACAGTTCGGTTTGCCCACTGGGGGTGCTGGCTTCTGCATCAATCGCAAACTGGCTTTG AAGATGGCTCCGTGGGCCAGTGGCTCCCGTTTCATGGACACATCTGCTCTCAT | SEQ ID NO: 2043 |
| PIM2 | ADXCRPDRC.11037.C1_s_at | GGTCATTACCAGTCATTAAAGTCCAGTATTACTAAGGTAAGGGATTGAGGATCAGGGGTTAG AAGACATAAACCAAGTCTGCCCAGTTCCCTTCCCAATCCTACAAAGGAGCCTTCCTCCCAGA ACCTGTGGTCCCTGATTCTGGAGGGGGAACTTCTTGCTTCTCATTTTGCTAAGGAAGTTTAT TTTGGTGAAGTTGTTCCCATTCTGAGCCCCGGGACTCTTATTCTGATGATGTG | SEQ ID NO: 2050 |
| TRIM14 | ADXCRPDRC.2569.C2_at | GCAGCAGCAGACTTGTTTAGGGCCTGTTTGAAACTAGCCTAGGAGAGGAAACCTTCAAAGCA CGGTAGGCGTGATGGGTCGGGAAAGCTGGGGCAGGGAGGGCCCTAAGAAGCAGGCAGTA AGGGGACCAGCCACGCTGATCTAGGTAGATTAGGCGAGACTGGGCAGCTGCGGCGACCTGGA GGCTGTCACGCCGGTCCT | SEQ ID NO: 2053 |
| AKAP1 | ADXCRPDRC.3886.C3_at | GTCTACATGATGTTGAGAGCCTTCTATGTGGCAGATCTGGACGCTCTGGGTGTAAGGCAGGG TTGAAATGTAGATCTTGGCACCAGATGTTTGCTTCAGAAAACTCACATAGCGCCCCTGCTTG CCAATTAGCCGACCGACTAAGTGCTTTGGCACCTCGATCTCCCAGATGATGAGGTCGACCTT CTTAGGGTTGGAGCCTGCCTGGGCATTTTGGAAGCTCTCAGTCTTCTTGAGACTGCAACAGC TATCCACGGAATCCATGCTGTTCCTGTCAGAACCCTGT | SEQ ID NO: 2054 |
| PDSS1 | ADXCRPDRC.11127.C1_at | GCACACCATCACTCTGTAGTACATACTGTCGAGCTCTGTCTACATCTCCAGGCAAACTGAAC CGTCGCATGATCATAGCATTCATTTCTGGGAACTGCTGACAGGCAAACAGGACAGGACCAGT GGCTAACCCGAGCTTCAGATCAGCTGATGTTGGTTTGCCCATCTGGTCAGAACACGAGGTGA AGTCCAATACATCATCTATTAGCTGAAAAGCTATTCCTACATTTTTTCCGTACTGATAGGCG ATCCCA | SEQ ID NO: 2058 |
| HNRNPA2B1 | ADXCRSS.Hs#S1848110_s_at | TCAAACGTGAATACAAATCCAGAGTAGATCTGCGCTCCTACCTACATTGCTTATGATGTACT TAAGTACGTGTCCTAACCATGTGAGTCTAGAAAGACTTTACTGGGGATCCTGGTACCTAAAA CAGCTTCACATGGCTTAAAATAGGGGACCAATGTCTTTTCCAATCTAAGTCCCATTTATAAT AAAGTCCATGTTCCATTTTTAAAGGACAATCCTTTCGGTTTAAAACCAGGCACGATTACCCA AACAACTCACA | SEQ ID NO: 2066 |
| CYFIP2 | ADXCRSS.Hs#S2524484_at | GGCTCAGTGCGCACAACTAGCTAGAGGCACTGACTTTGTAAGCAACAACACTATCTTCTTGA GGTCTAATAATTGCCTTGGCAAAGGGCAGCCAATGCCAACGAGGAACCCTGTGTACACAAGT TTCTCATCCCGAAAGTGGACACTGGGTGCTCAAAAAATGCCTTCTGGTGACAGTAACACCTG ACCAGTCAAACAAACATGCACGCA | SEQ ID NO: 2071 |
| IQGAP2 | ADXCRSS.Hs#S1611967_at | GCTTTAGTCCTGAATCTAATCACATGGAAATATATTCTTGATCCATGACTGTATTGTCAACA TATCCCCATTTGCATAGTATGATCCACTTGAGAGCTGAGTTGTCGGCAATATTTTTAAAATC GCCCTGAATCATGTGTTAATTCACACTCACTAACAGCATATGCTTGCATTAATAGCACCCGT CTGTTCAACATCATAATCTTCTAATGGTGTCTGTAATATAAAACTTCTCTTCCAAATATAAG TTTGACTTAAAGTCAGCTCCTTAGTATATCCCTTACCGATGGAAAGAC | SEQ ID NO: 2080 |
| CHD7 | ADXCRSS.Hs#S1919211_at | GAATCAACTCTATATAATCAACAAGAGAATTAGGCAAATAACATCTGGTTGCACTGATGGAC AAAGGACATAAAGATGTTATTTTCAAATGTCTTCTCCTGAAGAAAAATGAAAATTGTGTAGC CAGTCACCATTTTAGGCCACTCATTCTTGTCCAGTCATCTGTAGGATTATGGTTTGAGGGAC T | SEQ ID NO: 2093 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| SKAP1 | ADXCRSS.Hs#S1928672_at | ATATACCCAATGTCAAATCACTTTTTATGTATACACCAAAAAGGCACTCAATATTAGGACCT ATCCCATATCCAGGCACACAGTAGGGAACCGTACTCCAAAGTGACTATCTGCTAGGCCAGAA AAGACCAAGATAACCTTGTTAGTCTCCTTACCACTTAGAAATATTGTTTATGGTTTTAGAATC TATTTTTACAAAAATGGTTTTCTCTACCATATATAAATCCATGAAAAATATTGATGTTAATA TTCTTTCATTCCTGAGTTTAGTCAA | SEQ ID NO: 2116 |
| IQGAP2 | ADXCRSS.Hs#S1928867_at | GTGTATACAAAGCTCTTAGCACAGAGTGAAGCTCAGTGAACAAATGGCTCTTCTTATGAAGA GCAGCCCTCAGCGGAGGCATGGCACCTCCTTCAAGAGAACCAAACTTGGAAACCTTGAATTA GGAAGTGATTACTCACTTTACAGGGAATGACTACGGTAATGATATATTTGCTTTCTGTTACC TAAACTTAGCAGCTTACATATTTATCATCTAATGGTTTCTTTAGCTCAGAAATGTGGGCATA GCTTTATGGGTCCTCTACTT | SEQ ID NO: 2118 |
| BCL11A | ADXCRSS.Hs#S2731126_at | TGCAGTAACTGTGCGCCTATTGTAAAGGCAAATGAAGCTCACCTATTCCCTGCTGGGATCAG AAGTGACCTCACCACCCCCATGCCTCAAATCCTTCCCTTGCCAACCTAACTCAATGCCATT GCAGAATGACGAATGAGCTCAGAAATAGACCCCAAGTTACTAACCCTGCTAAGAAACAGCAAA AGCCTTTGCTGAAATGTTTTAAAAATGCATAGGGAGTGCAGCTGGCCAGTAAAAAGCAGGGA GACAAATTCCAATGAACCCAA | SEQ ID NO: 2139 |
| TOP1 | ADXCRSS.Hs#S2990754_at | AATGTTTTGTGCTTGGATTGAGTTTAGAGACACCAGATAGAATAAGATTGGCAACACTGTTA GCCACCTGCTGACCACAGCTAAACAGGCATATGTGCTTCTGCATGGGGAATGCTATGGCGTT AACAGAGCCTTCCTTAAAACCTGTAAGTTCGTTAGGCTTCCGGGTACCAGGGTTGTTAGAGT AGGCCACAGTTTACTTCCTTTTTCATAAGTGCTTTTCTTTCCTGGATCTCAGTATAGGAAGG AAAATCAGACAGCATTTCTCAATTGTTGACGCGTAAGGGCCA | SEQ ID NO: 2140 |
| USP7 | ADXCRSS.Hs#S2990382_at | GATAAATCTTCGTGAAGTGGCAGAAAATATGAAAGCCAGCCAATTGGAATCTTGCTTATTCT GATCTGTTATCTCAGGGGTTAGATTCGCGTGCTGAAGTGGTCTACGTAACTTCCATAGCGAT TGGGAGGTGTTCTCTGGTGGGGTAGCAGTTCTGTGTTATGACATCACACATGGAATTCACGG GGAGGAAAGCTGGGTATAGGCATTAAGTGCCCAGTAGAGCAGGT | SEQ ID NO: 2141 |
| TPT1 | ADXCRSS.Hs#S2979085_at | GGGTGCAGCACAAGTTCCTTCATAGGACTTTAAGACTCTTTGGGATCTAGTCCCTGCGTATC TCTCCAGTTCTCCTTACCATTCTCCTGTATCTGCCTCTGGCTGCAGCTGTGCCACAGCCAGA CTCTGGAAGGAGCCTCTTGCTGTCAATTATCCAACAAGTGTTTACTGGGTACCCACTTCTGC CAGGCACTGGGTTAGAGGTTGGAGACATAGCAGTAAAGACTTGCTCTAGTGGAAGACAA | SEQ ID NO: 2143 |
| CYFIP2 | ADXCRSS.Hs#S3733207_at | GCCTATGTTGTAGAATCCCTCGTACCCAGAGTGGGAGAAGATTACACCCGGGGCACTGCAGG GAGGGAACCAGGAGAGATGAAGTAGTAAGCTGAGGCATGCCCTTCTGGCCAGGCTGGCGTCT CTGGGCATGGCCACATCTGTTCACAGTCTGAGACTTGAGTCCTGGGGTCACACAAGGGCACT GGGTAGGAGATGTCTATCTTGGGAGGAGGTCTTGGGAAGCAACCACAGATAG | SEQ ID NO: 2161 |
| NFATC3 | ADXCRSS.Hs#S3740808_s_at | AAAAAGCAATTTCAACATGGAGCCAGTATGGAGAGATTGCAAGATTACCTAGAAAGTTACCA AAAGGCTATGCTCTGGAATGTCTTTTTATATTCCAACACTTCAATGATGGAATGGTCTCTTC TCATTTTATCTAACAACAGTTTAGTTTTATAAAGAGGTATGAGCTACATTTGGCTTTATTTC CTATAAATCTATGAACGTCTTCAGGACACATGCTGACTTTCTGAGGCA | SEQ ID NO: 2162 |
| CALML4 | ADXCRSS.Hs#S2988186_at | ACGTCTTTCCCGCTCACTGTAGCTGCCACCCATTCTTTTTAATCCCCAGAGAGCATACAGAT GAGCCCCAGTGGGCCATCTCAGCCACATAGGGGACAGGCCGGGGAGAGGATCTAGAGCTGGC CCAGGAAAGGAGGCCCTTTTCATTTTGAGGGAGGCCTCCCATCAGAGAAGGGTCCAGTCCTG CCCCGACCCTGTCCTTCCCATGATACCCACAATCCCAGGGTGACCTGTCTCCAGGGCAGAAG TGACAGACGAGGGCTAGGAGACTGGCTGAGGCCTAAGTCCTCTGCAAT | SEQ ID NO: 2163 |
| SKAP1 | ADXCRSS.Hs#S2988136_at | GAGAGAAGTGGGAAGCACTAGACACTTATCAAAC | SEQ ID NO: 2165 |
| SKAP1 | ADXCRSS.Hs#S2988136_x_at | GAGAAGTGGGAAGCACTAGACACTTATCAAACAACCAGATCTTGTGAGAACCCACTCACTAT CATGAGAGCAGCAAGGGGCAAATCTGCTCCCACGATCTAATCA | SEQ ID NO: 2166 |
| SKAP1 | ADXCRSS.Hs#S3015915_at | TCTACCTCAGACATTCCCATTCTAAATATGGTGGGCCTGACACTGCAAAACTGCTAAAGAAG TTCCACACAAAAATGTGTTTTAGCTTTAATTACTTATTCAGTTTAAACAAAAAGAATTTTT TTAAATTACCAGCTCTTTTGTTTTCAGTTCTCATAAATACATCTGGTTTCCCCCTCTCTC TATCTGATAAAAGTATTCTGAAAGGCAGAGTCCGGAGTGCCGAGGTTAGAGGATCTAGAA | SEQ ID NO: 2172 |
| SKAP1 | ADXCRSS.Hs#S3015915_x_at | CTAAGAATCCTTCTACCTCAGACATTCCCATTCTAAATATGGTGGGCCTGACACTGCAAAAC TGCTAAAGAAGTTCCACACAAAAATGTGTTTTAGCTTTAATTACTTATTCAGTTTAAACAAA AAGAATTTTTTTAAATTACCAGCTCTTTTGTTTTCAGTTCTCATAAATACATCTGGTTTCC CCCTCTCTCTATCTGATAAAAGTATTCTGAAAGGCAGAGTCCGGAGTGCCGAGGTTAGAG GATCTAGAA | SEQ ID NO: 2173 |
| TPT1 | ADXCRSS.Hs#S3017795_at | ACTACTCCAGATTTTTCACCTGCAAGTGGTAAGTCAGGCCAACTTCCGTTGGTGACCCGTTA TCTCTGCTTGAAAAAGATAAGGAGATTCTCCACTTTGGCCTCAGCTCTTAGCTAGGTTCTT TAGTCCAGCTAGGAGTTACTGAGCCTCCACCAAGAAGGTGAATCATTTGACCTCATTTAGCT CCTCCTCCTTATTTATCTTTATTAGAGCTTGCAGTGATGGAGAGTAAGTGATTGGGACCTCA AACTTCTAACACATAATTCTCTCAGGCGGGTTTGGAATGTACTCTA | SEQ ID NO: 2175 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| BLM | ADXCRSS.Hs#S3004537_at | GCTTACAACAGTCCATTCATCACCACTTCTTGTTCAGCTAGTTACATATCTGTCTTCAGACC ATGTTTCTGTTCTTTATCCATGGAGACACAAAAGACTTGACTATGTGACTCCAATAAGTTAG AGGTGTGAGGCAGCAAGAATGATTGGGTGGGACATTGACTCTAGAGTCCTACAGACCTGTAA TATAAACCTGTCTCCTCCTACTCTTTACTATGTGACTATAGCAAATAGTTTAACTTCTCTGG ACTTCAGTTTTTTCTTCTATAAAATGAGGAGAATGATATCTACCTTGC | SEQ ID NO: 2178 |
| PCBP2 | ADXCRSS.Hs#S3736726_at | ATCCCTAATAGGCTGGGCTTTGCAGGAAATGGCATGAAATCAGCTCTTCTGAGTGTACAGAA GAACCTTTCGAGCATTATTTCTACACCCTTCTCCCCCACTCTTTCCTCTTTGGAGGCTTCCA AGTTAGTGATGAATCCCAACAGCTAATGATGCTGGGTTTCCAGTTTATTTCCTTCTGTTAGT TTAATGTGCAAGTCAGTGAGGTTTTGAATGCTGTGCATTGAATTTGCTTGCTCTCTTCTGTC TTTTAGCAGGTTT | SEQ ID NO: 2209 |
| IMPDH2 | ADXCRSS.Hs#S3737705_x_at | GATCTTCACTTTCCGAACTTCATTGGCCTGGAATTCAGGTAGTACAGTATGTGGTGGATGAA GCCAACTACCGCCTGTAAGCTACAGGATAGAAAAGAGACTACTACTAAGTGACAAGAAGCAG GACTGAATGCCTTTGGGGGAAAGGCGGATGGAGTCCTTGCTCCTTTTCCCCAAACCCCATGG GGCTCACCGCCATTGCTATGGCCATCCCAGGCTTCTGTTGACTGTGTCCATTGGGAGAAGGA AAACCAGTGGGGTCTTAAGAAGTGATTTTCTTGGTCAGAGCAG | SEQ ID NO: 2216 |
| MYC | ADXCRSS.Hs#S854806_at | GGGAGGAGACTCAGCCGGGCAGCCGAGCACTCTAGCTCTAGGATGTAAACAGAGTAAGAGAG CCGCATGAATTAACTACGCGCGCCTACCATTTTCTTTTGCTCCCTCTCAAACCCTCTCCCTT TCTCTGCTGCTCCTCCGTAGCAGTACTGTTTGACAAACCGCATCCTTGTCCTGTGAGTATAA ATCATCGCAGGCGGAACAGCTG | SEQ ID NO: 2226 |
| IFITM1 | ADXCRIH.37.C1_s_at | GGGTTACTAGTAGCCGCCCATAGCCTGCAACCTTTGCACTCCACTGTGCAATGCTGGCCCTG CACGCTGGGGCTGTTGCCCCTGCCCCCTTGGTCCTGCCCCTAGATACAGCAGTTTATACCCA CACACCTGTCTACAGTGTCATTCAATA | SEQ ID NO: 2227 |
| RPL10A | ADXCRIH.799.C2_at | GTTGAGTTTTTTCAGCGCCTCGATGTCCATGTGGGGGATATCCACGGCCTTAGCCTCGTCAC AGTGCTGCTGGTCCCCAGGACACACACAGAGAACTTAGGGCGGGGAGTGGACTTAAGCCTG ACGGTGCCCGAGAAGCGCTTGTCCTTCTGGGGATCATAGTTCTTCAAGCTGATCTGCAACTC CACCGTCTCCAGGAACTTGCGGCGCTTGCGCTGGTTCCCGTGCAGGACTTCCCGCACCGCCT CGTACAGGGTGTCGCGAGAGACTTTGCTGCTCATGGCTTCTCA | SEQ ID NO: 2230 |
| GTF3A | ADXCRIH.2186.C1_at | CCCAGGGCCAGGCGCGCTGCCACGTGCCCCTGCA | SEQ ID NO: 2252 |
| GTF3A | ADXCRIH.2186.C1_s_at | TTTTTGATCACAGCCATTGGCTGCACAAACAAACGGCTTTTCTCCTGTGTGCTTGCACAGGT GCGCGTCAAGCTTCCAGGCTTTGCTGTAATTGGCGCTGCAGTCAGGGAAGGAGCAGATGAAC CTCCTGGGAAGCGCGGGGCGCGGCGGGGTCGGAGCTGAGCTCTCGCCGGCTGCAATGAACGC GTCGGCGATGGTCAAGGACGACACCGACTCGG | SEQ ID NO: 2253 |
| GTF3A | ADXCRIH.2186.C2_at | CAAGAGAAAGCTGTGGAAGACCTATACAACTGTGGTTTATCTCCAAAGCCATATCCCTCTTC TTCCATGAGGAAAGGCCGCCC | SEQ ID NO: 2254 |
| GTF3A | ADXCRIH.2186.C2_s_at | TGGCAAAAACATGGACGGAACTTCTGAAACATGTGAGAGAAACCCATAAAGAGGAAATACTA TGTGAAGTATGCCGGAAAACATTTTAAACGCAAAGATTACCTTAAGCAACACATGAAAACTC ATGCCCCAGAAAGGGATGTATGTCGCTGTCCAA | SEQ ID NO: 2255 |
| ATP5G2 | ADXCRIH.3160.C2_s_at | TCCCATAGTTCTCCCGCGTCTGGTTGGCCCCGTGTGTTCCTTTTCCTATACCTCCCCAGGCA GCCTGGGGAACGTGGTTGGCTCAGGGTTTGACAGAGAAAAGAC | SEQ ID NO: 2262 |
| RAD51C | ADXCRPD.305.C1_at | GTTCCTGCATTAGCCTCAGGGATTTAGAGATACTGTTGTTACTTCTGCATGTTCATTGCAAA CAGAAGGTTCCTTGAGCACCCGGAAACGGTCACGAGACCCAGAGGAAGAATTATAACCCAGA AACAATCTCAAGTGTACAAATTTATTGATGTTGTGAAATCTATGTGTACAGTGGACTTGTTA CCTTAAAGTATAAATAAACACATCTATGGCCATGAATG | SEQ ID NO: 2263 |
| RAD51C | ADXCRPD.305.C1_s_at | CAGGCCTTGCTTGTTCCTGCATTAGCCTCAGGGATTTAGAGATACTGTTGTTACTTCTGCAT GTTCATTGCAAACAGAAGGTTCCTTGAGCACCCGGAAACGGTCACGAGACCCAGAGGAAGA | SEQ ID NO: 2264 |
| RAD51C | ADXCRPD.305.C2_x_at | CTCTTAATTTTAAGTGTGTATGTGCATTAAACAAAAATTAGCTTACTANNNNNNNNNNNNNN NNNNNNNNNNNNNNNNNNNNNNNNNNNNNNACTCCACGAAACCACAATCCCAACCNAATCACA AAAACAAATTTTGGGCCCCTTCGGCCCCTCAGAAAACTTTCTAAAACCCTTTCGTTTGGGGG CGGGGCGCCCCCATAAGGTATAATGGGACCCTGGGCCCTAAGCGTGGNTTCCCTAGGAAAAA ACCCTGGGCCACCTGAACCAAATGGGCGCTGGG | SEQ ID NO: 2265 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| PRIM1 | ADXCRPD.724.C1_at | CCGTGAATTGGATGCCATTTCCACTAATGAAGAGGAAAAAGAGGAGAATGAAGCTGAATCTG ATGTCAAACATAGAACCAGAGATTATAAGAAGACCAGTCTAGCACCTTATGTGAAAGTTTTT GAACATTTTCTTGAAAATCTGGATAAATCCCGAAAAGGAGAACTTCTTAAGAAGAGTGATTT ACAAAAAGATTTCTGAAGACAGAGCTCCTCAAACCATTGTGGATATCTTCTGCCTTCAACCA CAGATCAAATACTTCAAGAGCCATTTAATAAA | SEQ ID NO: 2266 |
| PRIM1 | ADXCRPD.724.C2_at | GCCATTGCAACTGGCCGTATTAAGTCCTTTGTATCCTCACTGTTCCATACTAGCTCAGCCTA TGATGTGGACTTCAGCAAATGTGTAAGCAAATCTTTGTGCATGATGTGTGTTAAATAGAAGC ATTAGGCAAAAAGAATGTAAAAGTAAATGGGCTTTGTTTTGTTTCCTTTGCTGTTCTTCCA TATATTATC | SEQ ID NO: 2267 |
| TRIM14 | ADXCRPD.2569.C1_s_at | CATTCCCAAGGGAGCTTGCACGGTACTGACCGAGTGCTGAGACTACTGGTATTCCCAGCTGC CATGTGGCAGCAGCAGGAGCTACTAGAATATTCTCAGCACAGGAATGAGGCTTCCTTGGTTT CCATGTCTGTAAGGGTTACTGATCACTTACCTTCTTCTCTT | SEQ ID NO: 2276 |
| AKAP1 | ADXCRPD.3886.C2_at | TCTGCTGGTCGGTTCTGCTATGGGACTGTGTTCTGGGGACAGGGCTTAGGTGGTGATAGCGC TGGCAGGAAACCAGAGGCCTCTTGGTCCCACATGGGAGGACTACTTTTCCTGGCTCTGCCC CCTGGGCACCTTTTAAGTTTTCTAGGCGTTAGCTTAGAAAGGATGGTGTAGTTAGGACAGGA GATTGGGTGTGTCCAGAGTAGACGTTCACCACCTGAGACCTGGGTGGGACTAGAATCATGGG TTTGGATGGCGCTTGTTCTTTCTTCTGGTTGAGTCAGGCCTTAACA | SEQ ID NO: 2279 |
| DAZAP1 | ADXCRPD.4725.C1_s_at | GGCTTTGGACGAGGGCAGAACCACAACGTGCAAGGGTTCCACCCCTACCGACGCTAGCCCGC GGCCGCGAAGTCTTGCACGGCCCAGACCCAGGATTCCAAACTTGTGAACTCGTGACAATC ACAAACTTGGCGGCAAAGTGGCGACTCAACCCTTNNNNNNNNNNNNNNNNNNNNNNNAGGGCGCGAG GCTTTTGGAGCGGCTGTGGGTGTCGTCTGGACTGAGGTTTTTAAATATTTCTTTCTCTAACC CATCAGCACAATAAA | SEQ ID NO: 2280 |
| DAZAP1 | ADXCRPD.4725.C2_s_at | AAATCTACTGAGTGTATTTCTGTTTTTTGTTTAATTCCTTGCTTTTGTCGACTGACCTGCTT GGTAGTGTCTGAGGTGAACTGTGGGGGTTGCGCACAGCCAGCCGCGTGGATCCCACGCAGCG CTGAACCGAACCGAGTAGGAA | SEQ ID NO: 2281 |
| IRF7 | ADXCRPD.7919.C1_at | TGGCCAGGTGTCACAGGTGTCCACAGGTGTGGACTGAGGGCTTGTAGCCACCGACGCTGCCT CGGTATGGATCTCTTGGCAGAGGGGGCTACAGGTGTGACTGCAGGTGTGGCCGGCGCGCACA CATGAAGTCACAGGTGTTGAACCAGTGTCCAGGCCTGGCGGGAAGGCGCAGGCCGGATCACT GGGTGCCAGAGCCGCCGGGACGGGAAGTTTCGTCTCGCGGGGAAGTCAGGAGGGCCGGCGCT TTCACTCGTGCCGAATTAAACACCCGG | SEQ ID NO: 2289 |
| IRF7 | ADXCRPD.7919.C2_at | CTGCCGCGGCCGCCCAGTCTAATAAAAAGAACTCCAGA | SEQ ID NO: 2290 |
| IRF7 | ADXCRPD.7919.C2_s_at | AGAAGAGCCTGGTCCTGGTGAAGCTGGAACCCTGGCTGTGCCGAGTGCACCTAGAGGGCACG CAGCGTGAGGGTGTGTCTTCCCTGGATAGCAGCAGCCTCAGCCTCTGCCTGTCCAGCGCCAA CAGCCTCTATGACGACATCGAGTGCTTCCTTATGGAGCTGGAGCAGCCCGCCTAGAACCCAG TCTAATG | SEQ ID NO: 2291 |
| FBXL14 | ADXCRPD.10538.C2_at | AATCTCATTGGATTACTCCTCCTTACATTACTGCGTTTGGATTTGTAGTCTTAACAAGGCAA TAAATGGAAGGGGAAAGAAGGAATCAATTCATGGTAACTAGAATGTAATGAGCACTTGCATT AAGTCACAATTTAATTTGTATACTTTCGGAAATTCTTTCCTGGTTGTAAGCCTAAAGGGGCC TGCCTAG | SEQ ID NO: 2297 |
| LGALS9 | ADXCRPD.14181.C1_at | GCACAGTCCCTGTTCAGCCTGCCTTCTCCACGGTGCCGTTCTCCCAGCCTGTCTGTTTCCCA CCCAGGCCCAGGGGCGCAGACAAAAACCTCCCGGCGTGTGGCCTGCCAACCCGGCTCCCAT TACCCAGACAGTCATCCACACAGTGCAGAGCGCCCTGGACAGATGTTCTCTACTCCCGCAAT CCAGCTATGATGTACCCACAACCAGACATCCGAAGCGTAACATCAACCACCAG | SEQ ID NO: 2307 |
| LGALS9 | ADXCRPD.14181.C1_x_at | AGCTGTCCTACATCAGCTTCCAGAACCCCGCACAGTCCCTGTTCAGCCTGCCTTCTCCACG GTGCCGTTCTCCCAGCCTGTCTGTTTCCCACCCAGGCCCAGGGGCGCAGACAAAAACCTCC CGGCGTGTGGCCTGCCAACCCGGCTCCCATTACCCAGACAGTCATCCACACAGTGCAGAGCC CCCTGGACAGATGTTCTCTACTCCCGCAATCCAGCTATGATGTACCCACAACCAGACATCCG AAGCGTAACATCAACCACCAG | SEQ ID NO: 2308 |
| LGALS9 | ADXCRPD.14181.C2_at | AAGTCCATCCTCCTGTCAGGCACTGTCCTGCCCAGTGCTCAGAGGTTCCACATCAACCTGTG CTCTGGGAACCACATCGCCTTCCCACTGAACCCCGTTTTGATGAGAATGCTGTGGTCCGCA ACACCCAGATCGACAACTACCTGGGGGTCTGAGGGAGCGAAGTCTGCCCCCAAAATGCCCC TTCGTCCGTGGGCCAGAGCTTCTCAGTGTGGATCTTGTGTGAAGCTCAGTGCCTGACAGGAG GATGGACTTGGATGGGTACAGCCCCCCCAGAATGGTGGTGATAA | SEQ ID NO: 2309 |
| CALML4 | ADXCRAD_BQ928122_at | CTGGCCTGCAGGAAAGGAGCGCCCAGCTGCGCGCCTGGGCCGCCCGTCGCTCCCAGTGCTGC CGCCCTCGCGTTGCCTCCATGGCTGCCCCGCAGGCCCCTCGGCCCTGCCTTTTCCGAGGAAA AACGGTTCAGCTCGGTG | SEQ ID NO: 2341 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| CALML4 | ADXCRAD_BQ928122_x_at | AGGTCGAGGTGGAAGGGAGCCGTGCGGGCAGCCTCATCAGCGCTCACAGAGCCATGCCTGGC CTGCAGGAAAGGAGCGCCCAGCTGCGCGCCTGGGCCGCCCGTCGCTCCCAGTGCTGCCGCCC TCGCGTTGCCTCCATGGCTGCCCCGCAGGCCCCTCGGCCCTGCCTTTTCCGAGGAAAAACGG TTCAGCTCGGTG | SEQ ID NO: 2342 |
| ANP32A | ADXCRAD_AL547157_s_at | AAGAAGGTTATAACGATGGAGAGGTAGATGACGAGGAAGATGAAGAAGAGCTTGGTGAAGAA GAA | SEQ ID NO: 2357 |
| ANP32A | ADXCRAD_AL547157_x_at | GGAGGATGAAGAAGGTTATAACGATGGAGAGGTAGATGACGAGGAAGATGAAGAAGAGCTTG GTGAAGAAGAAAGGGGTCAGAAGCGAAAACGAGAACCTGAAGATGAGGGAGAAGATGATGAC TAAGTGGATAACCTATTTTGAA | SEQ ID NO: 2358 |
| BCL11B | ADXCRAD_CD701737_s_at | TTGCAGCATATTCTTCTCTTTGGCCCAGAGGTGGGTTAAACTGTAAGGGACAGCTGAGATTG AGTGTCAGTATTGCTAAGCGTGGCATTCACAATACTGGCACTATAAAGAACAAAATAAAATA ATAATTTATAGGACAGTTTTTCTACTGCCATTCAATTTGATGTGAGTGCCTTGAAAACTGAT CTTCCTATTTGAGTCTCTTGAGAC | SEQ ID NO: 2359 |
| USP7 | ADXCRAD_BU956106_at | CGCTCTTTCCCTTCATTGTGGGGCATTGTTCGGGCCCTTC | SEQ ID NO: 2368 |
| AKAP1 | ADXCRAD_BX394525_at | AACTCATTGAATTAACTTGCAGTGGTGTGTTTGATTCTTTTTTAGACTGGCTTCAGCATTGT GCAGTTTAA | SEQ ID NO: 2377 |
| NASP | ADXCRAD_BQ187021_at | CTGGGGCTATAATTCTGTCCTGGAAAAAGAACTCTGAAAACCTGGGTCAGGGGAATGATTCC TAAGGAAAACGGTCTGCATTTGAGCTCTGGTTTGAAAGTAGCCAAGGGGACTGATGGTGGAC ACTCCAGATGTGGTTGGAAGCATATGTGGGGAGGCTGGCTGGCTGAGTTTTGTTATTTTCTG TATAGAAAGGTTGAGATATATCAACACTTGGGATTGTTACCCATCTGCAGAATTGACTTCTC AAATAAAGATGCTA | SEQ ID NO: 2384 |
| MYC | ADXCRAD_CA454569_at | TAAATATTGGGCCATTAAATGGTAAATAAACTTTTAATAAAACCGTTTTATTAGCAAGTTAC ACCAGAAATTTCAATCCCCTAGGTATATATAGTACCCTCAAGTATTTATTA | SEQ ID NO: 2390 |
| HMGB1 | ADXCRAD_CN401906_s_at | AACTCATTCATTAGTCATGTTTATCTGCTTAGGAGTTTAGGGAACAATTTGGCAATTTTGTG GTTTTCGAGATTATCGTTTTCTTAAAGTGCCAGTATTTTAAAATAGCGTTCTTGTAATTTTA CACGCTTTTGTGATGGAGTGCTGTTTTGTTATATAATTTAGCTTGGATTCTTTCCATTTGC ATTTGTTTATGTAATTTCAGGAGGAATACTGAACATCTGAGTCCTGGATGATACTAATAAA | SEQ ID NO: 2402 |
| TRIM14 | ADXCRAD_BX389413_at | TGGTCTCACTGGGAGTTCATGGTGCTTCAGTCCCTAGCACCCAGTGATACCCCCACAGGTAG CCCTAAGCATCCTGAAACATCATCCGC | SEQ ID NO: 2407 |
| RNF44 | ADXCRAD_CX761728_at | TTTCTATTGTTGCTGATTCCGAGGGATATTCCCTATAATGTATGA | SEQ ID NO: 2410 |
| RNF44 | ADXCRAD_CX761728_x_at | AGTTACCTCATTTTTCCCATGTATGTATTTGAGAAAATGCTAATATATAGAGAAAAAAATGG TTCTTAAAGCTTAAATGTGTGGTTTTTTCCATTCCATGGGATTCACATTGGTTTGTAGCATT TAACATAACTAGTATGTTGTATTATATATATGTGTATACTGATTGAAATTTTTAACAGATTT GTACTTTTTTTAAAATGAAAGTTGCTAGTTCTGCTTGACCAAGTAGTGGCATCATTATTTTT TTTTCTATTGTTGCTGATTCCGAGGGATATTCCCTATAATGTATGA | SEQ ID NO: 2411 |
| ATP5D | ADXCRAD_AL548640_at | GAAGCCGCGCCTGCCAAGGAGGCCACCAGAGGGCAGTGCAGGCTTCTGCCTGGGCCCCAGGC CCTGCCCTGTGTTGAAAGCTCTGGGGACTGGGCCAGGGAAGCTCCTCCTCAGCTTTGAGCTGT GGCTGCCACCCATGGGGCTCTCCTTCCGCCTCTCAAGATCCCC | SEQ ID NO: 2419 |
| PIM2 | ADXCRAD_BQ953509_at | AATGTAAATAATCACGTATTGTGGGGAGGGGGAGTCCAAGTGTGCCCCTCCTCTCTTCTCC TGGCTGGATTATTTAAA | SEQ ID NO: 2423 |
| PIM2 | ADXCRAD_BQ953509_x_at | GGGAAATAAGGCTTGCTGTTTGTTCTCCTGGGGCGCTCCCTCCAACTTTTGCAGATTCTTGC AACCTCCTCCTGAGCCGGGATTGGCCAATTACTAAAATGTAAATAATCACGTATTGTGGGGG AGGGGGAGTCCAAGTGTGCCCCTCCTCTCTTCTCCTGGCTGGATTATTTAAA | SEQ ID NO: 2424 |
| LRMP | ADXCRAD_BG257134_at | ATTGAACTTACGGACTCGTTAAGCTTGAAGACAAAACAGGGGGGGCGCAAAGAACCCAGGA GGGCCAGCTACACAACCGTTCTGGTAAAGGCCACAAAGGGCGAAAAAGAAGCGCGGGTA ACACAGCAGGAAAAGCGGTATCCTAGGACAACTGGTGGATAGCACCCAAAGAGAGCAACATG TAGGAAGCCTGCGCACAGGTAGAACAGCAGCAAAAGCAGAACATCAGCGACATAGCAGA | SEQ ID NO: 2430 |
| TTF1 | ADXCRAD_BF700791_at | ATGGAAACGAGCACGGGAGATCACACCCGCGGGGACGGACGTAAAGTCCAGAGATGCAACCC AGCGGAGAAGATGGACAGACATGACGTGGAATGCGGCAAAGCGGAACCAGAGCGCACATCTAG | SEQ ID NO: |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| | | AGCGGGGAACGGACCAAGGAATCGGGGTCCCAAGACGTTGGGAAAAAGGGGCCCAGTTGTTA AAGGCCGGTCCACTGGAGCGGCCCGGGAGAAAAAACATCTTCCACTATACCTTTCAGGTTAA ACCCTGTGCCTTCAAC | 2433 |
| RHOH | ADXCRAD_BM919440_at | ATCCCTTGGGGGAACTGGTGATGAATAATTCCATCTTTGGATTAAAAAAGTGAAAATAGTCT CCCATAATTTTTGGGACCAATGAAGTTGAGT | SEQ ID NO: 2435 |
| RHOH | ADXCRAD_BM919440_s_at | GGATACAGTTATTGATGAGGCTTGGCCACTGGATGTTTTCACTAACTACACTCTACAAGTGA ACTCCTTGCCCAGGCCAGTTAGAAAATCCCT | SEQ ID NO: 2436 |
| LCP2 | ADXCRAD_BP391263_s_at | AACAGTAATAGTTATTGGTGTCACATAAAACTGATTTGTTTTTTACAGCCAAACCTCTGTCA GTCAGAGGCATTCATTAGTTTTATACATGTAATTTGAAAATCACTAAACCTCGTTTTCTCAG CAGCAA | SEQ ID NO: 2439 |
| FYB | ADXCRAD_BG759248_at | GTGTCTTCATCAAAAGGGTCCCCAGCTCCCCTGGGAGTCAGGTCCAAAAGCGGCCCTTTAAA ACCAGCAAGGGAAGACTCAGAAACATAAAGACCATGCAGGGGAGATTTCAAGTTTGCCCTTT CCTGGAGTGGTTTTGAAACCTGCTGCGAGCAGGGGAGGCCCAGGTCTCTCCAAAAATGGTGA AGAAAAAAGGAAGATAGGAAGATAGATGCTAAGAACACCTTCCAGAGCAAACATACAT CAGGAACGAGTCGGCCTCAGGGCACTCCT | SEQ ID NO: 2440 |
| FYB | ADXCRAD_BX095265_at | GATAAGCTTGCTAAACTTTCAGAGTGCCCTGAGACACTTCCAGCCATCCCTCCTCCTGCCTT CATTGGGGCAGACTTGCATTGCAGTCTGACAGTAATTTTTTTTCTGATTGAGAATTATGTAA ATTCAATACAATGTCAGTTTTTAAAAGTCAAAGTTAGATCAAGAGAATATTTCAGAGTTTTG GTTTACACATCAAGAAACAGACACACATACCTAGGAAAGATTTACACAATAGATAATCATCC TTAATGGGA | SEQ ID NO: 2441 |
| IKZF1 | ADXCRAD_BG685498_at | GTTAGTATAGAATTCTCGAAACTTGGGAATTCACAAATCAGGACTGGGGACTGCGAGACCAC AAATTTCTGATCGCATTTCTGATGGATGTGTCACACCTTTTCTGTCAAAACTAACATGTCTT GGAGGTTAATCGACGTCCCTTGGGTGGACACACACA | SEQ ID NO: 2443 |
| IKZF1 | ADXCRAD_BG685498_x_at | GTTAGTATAGAATTCTCGAAACTTGGGAATTCACAAATCAGGACTGGGGACTGCGAGACCAC AAATTTCTGATCGCATTTCTGATGGATGTGTCACACCTTTTCTGTCAAAACTAACATGTCTT GGAGGTTAATCGACGTCCCTTGGGTGGACACACACA | SEQ ID NO: 2444 |
| SNRPG | ADXCRAD_AV757070_s_at | GGTGGCAGACATGTCCAAGGAATATTGCGGGGATTTGATCCCTTTATGAACCTTGTGATAGA TGAATGTGTGGAGATGGCGACTAGTGGACAACAGAACAATATTGGAATGGTGGTAATACGAG GAAATAGTATCATCATGTTAGAAGCCTTGGAACGAGTATAAATAATGGCTGTTCAGCAGAGA AACCCATGTCCTCTCTCCATAGGGCCTGTTTTACTATGATGTAAAAATTAGGTCATGTACAT TTTCATATTAGACTTTTG | SEQ ID NO: 2445 |
| SNRPG | ADXCRAD_BX390183_s_at | GAGGTTCCCAATGTTTCGTCCAGAAAAGTACTTTATTTATGCAAGTCAGGTGACTCTTAGGC CACAAACCATTTGATGATAAACAGATTATCATTAGGTGCATATCTTATTGATATTTTGTGA AATGTTATGCCTATGTTGCAAAAGTTGA | SEQ ID NO: 2452 |
| NFATC3 | ADXCRAD_CR741943_s_at | GATCTGATGGGCTCTAACAGTGCTTACTGCAGCCTTGTGTCCACCACCAACTTCTCAGCATG TTTCTCTCCTTGGACCTTGGGTTTCCAACTCTGCAGCCTTCAGGTCTGGGGCCAGGAGTGGG ACCCACCATTTGTGGGGAAAGTAGCATTCCTCCACCTCAGGCCTTGGGTAGATTTGGCAAAA GAACAGGAGCAGCATAGGCTGTTTGAGCTTTGG | SEQ ID NO: 2460 |
| ATP2A3 | ADXCRAD_CB047171_s_at | AGCAGAAACCTGCACCAAGGATTGTCCCTATGTCTTGGCCCCTCCTAGAGCGTGTGCAGACT GATGATTTTATATGTAAATCAAGACTCACATCCCTTTCCTAGTCCCCCACATCCAAAGCCCC TCAGCCTGCCTTGCAGACCAATGGGCTCCATGTTCTGTAGCCCCCTCCCTACGCCTCACCC CTCCTCCCTCTCACAGGTTCTGGGCGGCCAGTGAGAGAAACGCAGTGGGGAGGCAGGGAGT CTGGTGCCTGCAGAGATTCTCTGCTT | SEQ ID NO: 2462 |
| NAP1L1 | ADXCRAD_BP220549_at | AGTTACTGGTACCACAGTGAGGTGAATAAAACGGATTTTCAGAAGTTAGCCTGAATTTAAC TGTATTTTAAATTTAACCTCCATTAACTAAGCATCTTTTCTTTGTGGTAGGGTCTACCTTC TGCTTCCCTGGAAAGGATGAATTTACATCATTCGACAAGCCTATTTTCAAGTTATTTGNTGG TTGTTTGCTTGTTTTTGTTTTGCAGCTAAAATAAAAATTTCAAATACAATTTTAGTTCTTA CAAGATAATGTCTTAATTTTGTACCAATTCAGGTAGAAG | SEQ ID NO: 2470 |
| NAP1L1 | ADXCRAD_BP220549_x_at | AGTTACTGGTACCACAGTGAGGTGAATAAAACGGATTTTCAGAAGTTAGCCTGAATTTAAC TGTATTTTAAATTTAACCTCCATTAACTAAGCATCTTTTCTTTGTGGTAGGGTCTACCTTC TGCTTCCCTGGAAAGGATGAATTTACATCATTCGACAAGCCTATTTTCAAGTTATTTGNTGG TTGTTTGCTTGTTTTTGTTTTGCAGCTAAAATAAAAATTTCAAATACAATTTTAGTTCTTA CAAGATAATGTCTTAATTTTGTACCAATTCAGGTAGAAG | SEQ ID NO: 2471 |
| TOP1 | ADXCRAD_BM541278_s_at | TTTTTGCTATAATCATTAGTTTTAGAGGCATTGTTAGTTTAGTGTG | SEQ ID NO: 2477 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| TOP1 | ADXCRAD_BM541278_x_at | AGCAGAATTTTTAATGTGAAGACATTTTTTGCTATAATCATTAGTTTTAGAGGCATTGTTAG TTTAGTGTGGTGGGCAGAGTCCATTTCCCACATCTTTTCCTCCAGGATCCTCCAATTTTTAT CATGAATTTCCCTTTTAATCAACCTG | SEQ ID NO: 2478 |
| PCBP2 | ADXCRAD_AW294074_s_at | GGAAAGTCTAATCCTCAATCTTTTGGGCACAAGTTTTATAAGGGCCAACCAAGCATGGAGTC AGGGAAAAATAGGATCGAGGGCCACAAA | SEQ ID NO: 2486 |
| USP7 | ADXCRAD_CA439064_at | GAAGGGCCTCGTGACACATCAGGTCACATCTCCAGTCACCTTATTTGTACACAGTTCTCTCC TGGAAAACCTTTCATTTCTTAAGAGTAAATGTGACTAGTTAGAGGCTAAAAAAAAAAAAAAA AAGAAACAAGAGACCCTGCCCCCGCAAAACGAATTAGAAGGAAAAGTACATCTCAGTGAAA CCTTGTTACAAATGCCAAGGTTTCCCAGGCCTGTTTCCAGGGAGAGTAGAATCTTCCTCCAC TTCCACGTAACTCACTGAATTATA | SEQ ID NO: 2489 |
| FYB | ADXCRAD_BX437100_at | GAAAATTAATGCACAAAACCACTTATTATCATTTGTTATGAAATCCCAATTATCTTTACAAA GTGTTTAAAGTTTGAACATAGAAAATRATCTCTCTGCTTAATTGTTATCTCAGAAGACTACA TTAGTGAGATGTRAGARTTATTAAATATTCCATTTCCGCTTTGGCTACAA | SEQ ID NO: 2517 |
| FYB | ADXCRAD_BX437100_x_at | GAAAATTAATGCACAAAACCACTTATTATCATTTGTTATGAAATCCCAATTATCTTTACAAA GTGTTTAAAGTTTGAACATAGAAAATRATCTCTCTGCTTAATTGTTATCTCAGAAGACTACA TTAGTGAGATGTRAGARTTATTAAATATTCCATTTCCGCTTTGGCTACAAWTTATGAAGAAG TTGAAGGTACTTCTTTTAGACCACCA | SEQ ID NO: 2518 |
| 41888 | ADXCRAD_BG284913_at | GGAGTGGCTTTTCTGGAAAACAACACAAGACAACAGAAAACAGGTGTACACATATCTCTCATT CTCTTAAGCCAAGAAGTGTGCTTCCCTAGCTGAAGTGTAGATGGTCGTGTAGGGGTGGGTGG AAAATCATGTGGCATACAGGTGTGGGTGTAATAT | SEQ ID NO: 2533 |
| 41888 | ADXCRAD_BG284913_x_at | GGAGTGGCTTTTCTGGAAAACAACACAAGACAACAGAAAACAGGTGTACACATATCTCTCATT CTCTTAAGCCAAGAAGTGTGCTTCCCTAGCTGAAGTGTAGATGGTCGTGTAGGGGTGGGTGG AAAATCATGTGGCATACAGGTGTGGGT | SEQ ID NO: 2534 |
| MDN1 | ADXCRAD_BE777779_at | TGTTAATCCCTAAAAAAGGCTATGCAGGTAATAATTCTGGAAAACTTATTTAAAACATTTTC CAAGGGTTGGTGGGTGTTCAAAAACACACCGGAGAAGAAAGAGCTTTTGAGAACAAGAAAGA AACGAAGAAAAAAAGAGAAAGAAAAAAAAAAGGGGGGGGGAATAATTCGGGGAAGAAGAG ACTTTTAAAAGGGACAAGAGGTAAAAAGGGGGGAAAGAGAGGAAACGGGTGTGGACTTGG | SEQ ID NO: 2538 |
| ATP2A3 | ADXCRAD_BX328303_at | AGGTCCAACTTTGCACCCGCGTTCTTGGTACCTGAGACCACCGACATCCTCAGGTTCCTGAC CGTGCGGCCTTCTACCCA | SEQ ID NO: 2544 |
| ATP2A3 | ADXCRAD_BX328303_x_at | AGGATGTCCTTTCCCGGGAGACAAGTCGNGAAAGCCTGGCTGGACTGCCTCAGCCCCGCGCG CCTNCTGGACTCAGGGTTCCCCGTCCTGAGCTCNGGGAGATGTCAGAGTCACACTGCCGCCC GGTCTGCCACGCAGAGGTCCAACTTTGCACCCGCGTTCTTGGTACCTGAGACCACCGACATC CTCAGGTTCCTGACCGTGCGGCCTTCTA | SEQ ID NO: 2545 |
| HNRNPA1 | ADXCRAD_CN296684_s_at | GAACTGATAGTTACTGTTGTGACCTGAAGTTCACCATTAAAAGGGATTACCCAAGCAAAATC ATGGAATGGTTATAAAAGTGATTGTTGGCACATCCTATGCAATATATCTAAATTGAATAATG GTACCAGATAAAATTATAGATGGGAATGAAGCTTGTGTATCCATTATCATGT | SEQ ID NO: 2549 |
| CD3D | ADXCRAD_BX457462_s_at | CGTGGCTGGCATCATTGTCACTGATGTCATTGCCACTCTGCTCCTTGCTTTGGGAGTCTTCT GCTTTGCTGGACATGAGACTGGAAGGCTGTCTGGGGCTGCCGACACACAAGCTCTGTTAGG AATGACCAGGTCTATCAGCCCCTCCGAGATCGAGATGATGCTCAGTACAGCCACCTTGGAGG AAACTGGGCTCGGAACAAGTGAACCTGAACTGGTGGCTTCTAGAAGCAGCCATTACCAACT GTACCTTCCCTTCTTGCTCAGCCAATAAAT | SEQ ID NO: 2553 |
| 41888 | ADXCRAD_BQ941634_at | ATCACCACCATTCTGCTGTTCAGTGTCTCTTGAGAGAGCCTCTTTGCATGTTTTCCAGAATC TGTGTGTGTTTTTCCTTTCTTCTCCTTTGTTCTTTTTGCTCAAAGGTGTGACCAGTCATTGC CCCCTCTGGGGCTTTCATTCTCCAGGAGAAACATCCCAGAACCAGCACTGTTTAGCCTGATA CCTTTCTAATGTCCATGTCAATTTTCAATAA | SEQ ID NO: 2554 |
| NAP1L1 | ADXCRAD_CX870261_s_at | CAAGGGACGTGGGACAGTTCGTACTGTGACTAAAACAGTTTCCAATGACTCTTTCTTTAACT TTTTTGCCCCTCCTGAAGTTCCTGAGAGTGGAGATCTGGATGATGATGCTGAAGCTATCCTT GCTGCAGACTTCGAAATTGGTCACTTTTTACGTGAGCGTATAATCCCAAGATCAGTGTTATA TTTTACTGGAGAAGCTATTGAA | SEQ ID NO: 2555 |
| SHMT2 | ADXCRAD_BP384660_s_at | AACAAGACTTAGAAGGAGGGCCCAGGCACTTTCTGTTTGAACCCCTGTCATGATCACAGTGT CAGAGACGCGTCCTCTCTTCTTGGGGAAGTTGAGGAGTGCCCTTCAGAGCCAGTAGCAGGCAG GGGTGGGTAGGCACCCTCCTTCCTGTTTTTATCTAATAAAATGCTAACCTGCCCTGAGTTTC CATTACTGTGGGT | SEQ ID NO: 2559 |
| HMGB1 | ADXCRAD_BX429991_at | GTATGGTCTAACCTTTACCATAGGACTTTATTCTTTAAACTCCATTACATGTAAGGGCCGTT ATATTTTGCAGCCTCCACATTAAGAATACTTGGTATGCTTTCTCCAAAGCGGTGAGCTTATA TACAAGACTGGCATATTAAAATTTTCCGCTACACTTACTCCAAGAAAGCTTTGGAATAGCAG TCTTAT | SEQ ID NO: 2572 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| BLM | ADXCRAD_AV763452_x_at | ACACACACACACTTAGCCAGGCATGGTGGTGCATGCCTGTAATCCCAGCTACTTCAGATTCT GAGGCAGGAAGAATCACTTGCCCCAGAGGCAGAGTTTGCA | SEQ ID NO: 2573 |
| GCN1L1 | ADXCRAD_BQ890025_at | TCCAGTTTAGCCATGGCTAGGGTCCTGGAACTATAATAAGCAAGGGTCCAGACTGGTGGGGT TTCCTCCTTTCTCCTGTGGCTTGGAACCTCTTGGGTTTGAAAAGCTGGGCGCCTACCNAAAC CCTTTTTTTTCCCTATAATCCCCGGAATTGGGGGGCAACAGAACGGTTGGGGAATCTCCTG | SEQ ID NO: 2576 |
| RPS6 | ADXCRAD_BQ955249_at | ATCTGAGCATTTAGCCTAAGGCAGTTAACTCCTACAAAGTGTCCATGAAACCAATACATCTG AAAAGGCCTATGCTCCAATGCAGATCTGGAATCCATGAGCAGTTTTGGAGTACCGATCAGAT TAATGAAGATACTTTAACAACCTGCCACCTAATCTGGTGGTAATAGGTAACGTTACCCCTGA ATTTGGCGGAATTGGCCAAGGAAAATAAAGATGGCAAGCTTACATCAAATTTTA | SEQ ID NO: 2578 |
| HSPD1 | ADXCRAD_BM313583_s_at | AACAGCATGATTGGGTTAGGAATTTGCATAGGATGAGTTCAGTGGTGAGACTTTTGAAACTA CACACATCTACCTTGTTTTAGTCCTATTTTCAAAATTTTGGCATTGTGAGATTTTATTTACT GTGTGAACCTAAGTTACTGTTTAAGTACATGCCACGCAACTCTGTGTTATTAAGAAGCACT GTCTCAGAAGCTGTGTGTAAATTTAATATTAAGGCACTAAAGACCAAGCATAGGTACATGCC TGTA | SEQ ID NO: 2588 |
| CYFIP2 | ADXCRAD_AV725374_at | GATATTTTGAATTGTATCTTGCGGGTCCCTGTGTTGAAGTGATAAACATTTGCATCTTATTA AAACTGCTTTCACACTTGTAGACCCCACAACTTACAACAATTAATTGGCCGTTGTTTTACAA CGGCTGACTGGGAAACCCTTGCCGTCCCCAACTTTATTGCTTGT | SEQ ID NO: 2591 |
| WDR59 | ADXCRAD_AA393120_at | CCCCTAGAAAATCTCCTGGAAGAGAGGAAATCAGATCAACTGGGGCTGCCTCAGACCTTGCAG CAGGAATTCTCCCTGATCAATGTGCAAATCCGGAATGTCAATGTGGAGATGGATGCGGCAGA CAGGAGCTGCACAGTGTCTGTGCACTGCAGCAACCATCGTGTCAAGATGCTGGTGAAGTTCC CTGCACAGT | SEQ ID NO: 2596 |
| USP7 | ADXCRAD_CA437914_at | TGTGTACCTTGGAGTGACTTCCTTTCTCAACTTCCACTGCAGTGTGTGTGCCTTCTGCTCTG AGAGCTGCCTTGTGACCCGTGTGATAGAAAGCAGGGAGTGAGGGTCCCCGCGGACCTGGCCC TTCCCTCCTTCCTCCCCCAGAAAGAGGAGTTAGAGCAGGGTGCGAGAGCCGTTCGCTGTGG GTTTGTCTTTGAACAAACATTAAGGTGTCTTGTTTTTGTTCTGGGCTGGGGGTTGGCTGTAG TCTTAGGTAACTGAAAGTTCCTACTCTCCCTTAAG | SEQ ID NO: 2597 |
| HMGB1 | ADXCRAD_DN601918_x_at | GATGCTTCAGTCAACTTCTCAGAGTTTTCTAAGAAGTGCTCAGAGAGGTGGAAGACCATGTC TGCTAAAGAGAAAGGAAATTTGAAGATATGGCAAAAGCGGACAAGGCCCGTTATGAAAGAG AAATGAAAACCTATATCCCTCCCAAAGGGGAGACAAAAAAGAAGTTCAAGGATCCCAATGCA CCCAAGAGGCCTCCTTCGGCCTTCTTCCTCTTCTGCTCTGAGTATCGCCCAAAAATCAAAGG AGAACATCCTGGCCTGTCCATTGGTGATGTTGC | SEQ ID NO: 2603 |
| PTMA | ADXCRAD_BG706596_at | GGATGGACGATGACCGATGACGGAAGCTGAGTC | SEQ ID NO: 2606 |
| PTMA | ADXCRAD_BG706596_x_at | TGGACGATGACCGATGACGGAAGCTGAGTCAGCTACGGGCAAGCGGGCAGCTGAAGATGATG AGGATGACGATGTCGATACCAAGAAGCAGAAGACCGACGAGGATGACTAGACAGCAAAAAG GAAAAGTTAAACTAAAAAAAAAAAGGCCGCCGTGACCTATTCACCCTCCAATTCCCGTCTC AGAATCTAAACGTGGTCACCTTCGAGTACGAGAGGCCCGCCCGCCCACCGTGGGCAGTTGCC ACCCGCAGATGACACGCGCTCTCCACCAGCCAAGCCAAACCATGAGAAT | SEQ ID NO: 2607 |
| PAICS | ADXCRAD_CX785294_at | GTGATGTCTGGGAACACTGCATATCCAGTTATCAGCTGTCCTCCCCTCACACCAGACTGGGG AGTTCAGGATGTGTGGTCTTCTCTTCGACTACCCAGTGGTCTTGGCTGTTCAACCGTACTTT CTCCAGAAGGATCAGCTCAATTTGCTGCTCAGATATTTGGGTTAAGCAACCATTTGGTATGG AGCAAACTGCGAGCAAGCATTTTGAACACATGGATTTCCTTGAAGCAGGCTGACAAGA | SEQ ID NO: 2609 |
| AKAP1 | ADXCRAD_CN407762_s_at | GCCTTGCCCAGTGGGTAGACAGCTACTACACAAGCCTTTGACCCCCATGCTGCTTCCTGAGA GTCTTTTTTTGCACTGTTGAAATTGGGCTTGGCACTCAAGTCAAAGATGAACATCGGAATAA CAAACATTGTCCTCTCCAGAAAGTCCTTTCTTTCTCCATACTGTAGTCCTATTGAGAAGACA TTTCGTCTCTGAGAAAAAAAGGATGGAACTATGGGTTCTCTTCGCAAAGCCAAAGGATAGTG TTTAACAAGCCAGCT | SEQ ID NO: 2613 |
| HMGB1 | ADXCRAD_CX757597_at | GAAAAGCGCCCATGTAACACAAACTGCCATTCAACAGGTATTTCCCTTACTACCTAAGGAAT TGTACCATTGCTCAGAATTGTAGGATTTACTATGTTGAAACTACAGGAGAGCCGGGCGCATG GTCACCCTGTATCCAGCCTTTGGAGGCANGCGGCAATCACAGTCAGAATGAACATCTGCTAC TGTGAACCGCTCATAAATCAAAATACACTGTGCTGCCTGATCATATCGAGTAGCGAATGTGA CGAGGATCAGACATGCTGCCACGGA | SEQ ID NO: 2620 |
| TTF1 | ADXCRAD_BX457598_s_at | AGGCCGGGACTGATATGCAGGAATCCCAGCCTACTGTGGGCTTGGATGATGAAACTCCACAA CTACTAGGAMCCTACTCACAAAAAAAAGTCTAAGAAAAAAAGAAGAAAAAGTCCAATCACC AGGAATTTGAGGC | SEQ ID NO: 2624 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| CBFA2T3 | ADXCRAD_AW955147_x_at | ATCTGTGTGCGTGGCTATCAGGAGTTCTAGGAACTCAGTGCAATACGGGAGTGACCCAGCTACTTGACCAGCCACGAACAGCCCGCCAGAGGCCCTGAACTGGACGGTACGTTAATGTGAATGTTATAGTCTTTGCAAAATCCCAAAGGATTTCATGAGGGTAATAAACAG | SEQ ID NO: 2638 |
| NAP1L1 | ADXCRAD_BQ884238_at | GACTATGACCCAAAGAAGGATCAAAACCCAGCAGAGTGCAAGCAGCAGTGAAGCAGGATGTATGTGGCCTTGAGGATAACCTGCACTGGTCTACCTTCTGCT | SEQ ID NO: 2641 |
| TOP1 | ADXCRAD_CN309141_s_at | GGAAGCTCAGAAAAGCATAAAGACAAACATAAAGACAGAGACAAGGAAAAACGAAAAGAGGAAAAGGTTCGAGCCTCTGGGGATGCAAAAATAAAGAAGGAGAAGGAAAATGGCTTCTCTAGTCCACCACAAATTAAAGATGAACCTGAAGATGATGGCTATTTTGTTCCTCCTAAAGAGGATATAAAGCCATTAAAGAGACCTCGAGATGAGGATGATGCTGATTATAAACCTAAGAA | SEQ ID NO: 2643 |
| NCKAP1L | ADXCRAD_BM479866_at | AACAGGGAGCCGACTTATAACACTAGGGCCCGGGGTCCCCCCTTTTTACCACACTTCCGACTGGCCAAAAACCGGCTTACCTTTCGGAACCCTTGGGGAAGGAGACACCTACTCCTCTCGGGGCGCGGAACCTACATTGGTACAAAAT | SEQ ID NO: 2648 |
| TMPO | ADXCRAD_BX482009_s_at | AAAAGGGACGCTCCATTCCCGTATGGATAAAAATTTTGCTGTTTGTTGTTGTGGCAGTTTTTTTGTTTTTGGTCTATCAAGCTATGGAAACCAACCAAGTAAATCCCTTCTCTAATTTTCTTCATGTTGACCCTAGAAAATCCAACTGAATGGTATCTCTTTGGCACGTTCAACTTGGTCTCCTATTTTCAATAACTGTTGAAAAACATTTGTGTACACTTGTTGACTCCAAGAACTAAAAATAATGTGATTTCGCCTCAATAA | SEQ ID NO: 2649 |
| EWSR1 | ADXCRAD_CN353264_s_at | GAAAAGTGGGACTAGACACGGTGTCCATATGGAGAGGAAAAATATACATAGAATATTTTAACAAAATGTATTCATTGTATAAATGGAATCCTTCTGTAACTTTGGTAACTGCATACTTGTTGTTTGGTAATGAACCAGAGGAGGTATAATACTCTAGAATTGTGTAACATT | SEQ ID NO: 2650 |
| FYB | ADXCRAD_BF510133_at | CAAGAGAAGAGTAATACGTGGTCCTGGGGGATTTTGAAGATGTTAAAGGGAAAAGATGACAGAAAGAAAAGTATACGAGAGAAACCTAAAGTCTCTGACTCAGACAATAATGAAGGTTCATCTTTCCCTGCTCCT | SEQ ID NO: 2653 |
| FYB | ADXCRAD_BF510133_s_at | TCCCTGCTCCTCCTAAACAATTGGACATGGGAGATGAAGTTTACGATGATGTGGATACCTCTGATTTCCCTGTTTCATCAGCAGAGATGAGTCAAGGAACTAATTTTGGA | SEQ ID NO: 2654 |
| FYB | ADXCRAD_BF510133_x_at | AGAGAAGAGTAATACGTGGTCCTGGGGGATTTTGAAGATGTTAAAGGGAAAAGATGACAGAAAGAAAAGTATACGAGAGAAACCTAAAGTCTCTGACTCAGACAATAATGAAGGTTCATCTTTCCCTGCTCCTCCTAAACAATTGGACATGGGAGATGAAGTTTACGATGATGTGGATACCTCTGATTTCCCTGTTTCATCAGCAGAGA | SEQ ID NO: 2655 |
| 41888 | ADXCRAD_CR743228_s_at | TCAGGAGCCACAGCCATTTCTTAGAGGGTTTCAAAAGGACAGCCTTTGGCGCCTTTTCCTTCTAACCTTTGAGTCCAGCCCTTTCCAGTTTTCATTCACTCGAAGTAACTGCACTCAAGCTGTGCTCAAAATCGGCAACGCATTTATTTACACCAAGCCCTTCCCATAAAACACAACTGCTGAAGAAAATAGCAGACGTTTCCCCTCTCTAACTCTGGGTATCCCACAGATGCAAAGG | SEQ ID NO: 2661 |
| SHMT2 | ADXCRAD_CX788770_at | ACTGCCAAGCTCCAGGATTTCAAATCCTTCCTGCTTAAGGACTCAGAAACAAGTCAGCGTCTGGCC | SEQ ID NO: 2669 |
| SHMT2 | ADXCRAD_CX788770_s_at | TCAGCGTCTGGCCAACCTCAGGCAACGGGTGGAGCAGTTTGCCAGGGCCTTCCCCATGCCTGGTTTTGATGAGCATTGAAGGCACCTGGGAAATGAGGCCCACAGACTCAAAGTTACTCTCCTTCCCCTACCTGGGCCAGTGAAATAGAAAGCCTTTCTATTTTTGGTGCGGGAGGGAAGACCTCTCACTTAGGGCAAGAGCCA | SEQ ID NO: 2670 |
| PTMA | ADXCRAD_BM685721_s_at | GAAAAACAATCTTATTCCGAGCATTCCAGTAACTTTTTTGTGTATGTACTTAGCTGTACTATAAGTAGTTGGTTTGTATGAGATGGTTAAAAAGGCCAAAGATAAAAGGTTTCTTTTTTTTTCCTTTTTTGTCTATGAAGTTGCTGTTTATTTTTTTTGGCCTGTTTGATGTATGTGTGAAACAATGTTGTCCAACAATAAACAGGAATTTA | SEQ ID NO: 2679 |
| GTF3A | ADXCRAD_BM729250_at | ATATGTCTGTTTTTCCACTACCGTATCATTGCTGTTCACATGTAATGTGTTGTTTGTTCACAACAAGCGCTGGTTACACATTACACTGACGAATGTGCTGATGCTCCAGCCATGGCTTTGATGCTTCTGTCATTTTTAACCTCTTCTATTAATATTTACTGCCTGTGCCATTCTTTTCCTTGTTGGCCATTCACAAGGCTTGGATAATCGTGTGACATTTTGAGAGCCATCAGATGTTACGTTTCTCAA | SEQ ID NO: 2680 |
| BCL11A | ADXCRAD_BU164469_x_at | TATCTTTTACTATGGGAGTCACTATTTATTATTGCTTATGTGCCCTGTTCAAAACAGAGGCACTTAATTTGATCTTTATTTTTCTTTGCTTTTATTTTTTTTTTATTTAGATGACCAAAGGTCATTACAACCTGCGCTTTTTATTGAATTTGTTTCTGGCCTTTGTTAAGTTCTATTGGAAAAACCACTGTCTGTGGTTTTTTTGGCAGTTGTCTGCATTAACCTGTTC | SEQ ID NO: 2684 |
| PVRIG | ADXCRAD_BX437785_at | TGTCATCCCCTTACTTTAATTCTTGGGCCTCCAATAAGTGTCCCATAGGTGTCTGGCCAGGCCCACCTGCTGCGGATGTGGTCTGTGTGCGTGTGTGGGCACAGGTGTGAGTGTGTGAGTGACAGTGACCCCATTTCAGTCATTTCCTGCTGCAACT | SEQ ID NO: 2685 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| PVRIG | ADXCRAD_BX437785_x_at | GCCCAGGGCCATGGAAGGACCCTTAGGAGTTCGATGAGAGAGACCATGAGGCCACTGGGCTT TCCCCCTCCCAGGCCTCCTGGGTGTCATCCCCTTACTTTAATTCTTGGGCCTCCAATAAGTG TCCCATAGGTGTCTGGCCAGGCCCACCTGCTGCGGATGTGGTCTGTGTGCGTGTGGGCAC AGGTGTGAGTGTGTGAGTGACAGTGACCCCATTTCAGTCATTTCCTGCTGCAACTAAGTGAG CAACACAGTTTCTCTGATGT | SEQ ID NO: 2686 |
| RNPS1 | ADXCRAD_CX785467_at | GATCGGAATGCAAATCTAGTTCTGGGTTCACTGCCTTCTCACTT | SEQ ID NO: 2688 |
| RNPS1 | ADXCRAD_CX785467_x_at | GATCGGAATGCAAATCTAGTTCTGGGTTCACTGCCTTCTCACTTGTCCCCTCGCCCCTAGTA ACTTTCTGTTCCTCACCA | SEQ ID NO: 2689 |
| PTPN7 | ADXCRAD_BG388017_x_at | TGAGCCCTGTGAGAGGCACGACTGTCTATGCCAATGAGGCTCGGTGGGGGGCTCTCAAGTGC CTGATCCTGCCCTGGGCTCAGAGCCAGCCCAGAGGGAAGCAACTGCACAGCCCCACAGGCCC TCCTTGGGCACTGTCCCCCAGACCCATCTCAGAGCTCAGAGGGTACAAGCTCCAGAACAGT AAGCAAGTGGGAAATAAAGACTTCTTGGATGACTGAAGACAAAAAA | SEQ ID NO: 2705 |
| ITGB7 | ADXCRAD_BQ642465_at | AAGGCTCTTTCTCCTTGGAGACAATGGGAACTGGAGGGTGAGAGGAAAGGTGGGTCTGTAAG ACCTTGGTAGGGGACTAATTCACTGGCGGAGTTCGGCCACCACCCTACTTCATTTTTAAAGG GACACCCAAGAGGGGCTGCTTTCCATTGCCTGGAACCCTTGAATTCCATCTGGGGCCTACCC CCAACCCAAAGAAAAACAAATAAAAGCCCTTAACCCCCCGGGAGAAAAGAAAGNNAGAGGAA AAAAACCTCCCGAGGGCCATTCTAATTGTTCCGCGGTGGGCG | SEQ ID NO: 2713 |
| ATIC | ADXCRAD_BU189824_at | TCTTCCCTTTCCGAGATAACGTAGACAGAGCTAAAAGGAGTGGTGTGGCGTACATTGCGGCT CCCTCCGGTTCTGCTGCTGACAAAGTTGTGATTGAGGCCTGCGACGAACTGGGAATCATCCT CGCTCATACGAACCTTCGGCTCTTCCACCACTGATTTTACCACACACTGTTTTTTGGCTTGC TTATGTGTAGGTGAACAGTCACGCCTGAAACTTTGAGGATAACTTT | SEQ ID NO: 2723 |
| AKAP1 | ADXCRA2D_CN407756_s_at | GGCTCATGCTGCCTGATGGCATCACCGTGGAGGTCATTGTGGTCAACCAGGTCAATGCCGGG CACCTGTTCGTGCAGCAGCACACACACCCTACCTTCCACGCGCTGCGCAGCCTCGACCAGCA GATGTACCTCTGTTACTCTCAGCCTGGAATCCCCACCTTGCCCACCCCAGTGGAAATAACGG TCATCTGTGCCGCCC | SEQ ID NO: 2724 |
| EWSR1 | ADXCRAD_BG910390_s_at | GAGCGCAGAGATCGGCCCTACTAGATGCAGAGACCCCGCAGAGCTGCATTGACTACCAGATT TATTTTTTAAACCAGAAAATGTTTTAAATTTATAATTCCATATTTATAATGTTGGGCACAAC ATTATGATTATTCCTTGTCTGTACTTTAGTATTTTTCAC | SEQ ID NO: 2726 |
| PTMA | ADXCRAD_BP384625_x_at | AGAGACGCCCCTGCTAACGGGAATGCTAATGAGGAAAATGGGGAGCAGGAGGCTGACAATGA GGTAGACGAAGAAGAGGAAGAAGGTGGGGAGGAAGAGGAGGAGGAAGAAGAAGGTGATGGTG AGGAAGAGGATGGAGATGAAGATGAGGAAGCTGAGTCAGCTACGGGCAAGCGGGCAGCTGAA GATGATGAGGATGACGATGTCGATACCAAGAAGCAGAAGACCGACGAGGATGACTAGACAGC AAAAAAGGAA | SEQ ID NO: 2734 |
| ANP32A | ADXCRAD_CN349881_s_at | TTGTAAATAGCAACCTAAAGGCGTATTTTGGCACTGGTCTGGGGACATTCCCCATCTCTCAT CCCTTTTCCCCCTTCACAGATGGTGGTGGGCTTCGCTCTACAAAGAGGACTCTGATGTTACT CTTGAGCTTATGAGCCAGAGAGCTGAAAACCGCAGGCTTGTTGTGTTAAGTTACAAGGAAAA TGGATTTGGTAATTAAAATTGAGAAGAAACACACCTTCAAACTTCAACTTCTTTAAAAGAAAA AAAAAACTGTCCTATCTTGTTCTGTAAAATATTAGAACGCTTTGT | SEQ ID NO: 2736 |
| TRIM14 | ADXCRAD_BI222503_at | CACTTAACCCCTCAGCTATGAAAAGGCTTCCAGGAGTTTCCATGACATAACAAAACAACAAT ACAAGCGCCTCACCTTAGCATTCAAGGCTTGTCTAGTCTGCCCAACAATTACTTATCCTCAC CTAGCTCCTACCAGTCTTCTTAGAGACTCTCCAGTCAGAACATGTGTCGCATAGTTCCACTC CACACCTCTCTGCTGACAGCACATTCATGCAGACAAGTCTTTCCACTGTCTCAGACTTCCGC AGGCTTACCTGCGCAGGCAAGTCTAACCAA | SEQ ID NO: 2740 |
| EWSR1 | ADXCRAD_BG619847_at | ATAATTATGGGCTCACTTCCTACTGGAGATGTTGAAAGTCTAAATCGGTTTGACCATTTTGA TTGATGGCACAATCTGGTTTAGAAAACTTTGTTTAGATCAATGACATAACCCTGCTGCCTCT GCCTGCCCTTCCCCTCCCTTCTCCCATCCCCTTTTCCCTATCTGGTGTCTGTACTTTGATGA AGGTGAGCTATAATATTGGTGGTTAATATAATCCAGAAGGCTTAGTTCTGTGTGT | SEQ ID NO: 2747 |
| CHD7 | ADXCRAD_CN341021_s_at | GGATATAAACACTTTGACAGGAGAAGAAAGGGTGCCTGTTGTCAATAAACGAAATGGGAAGA AGATGGGTGGAGCTATGGCGCCTCCAATGAAGGATCTACCCAGGTGGCTGGAAGAAAATCCT GAATTTGCAGTTGCTCCAGACTGGACTGATATAGTTAAGCAGTCTGGTTTTGTTCCTGAGTC GATGTTTGACCGCCTTCTCACTGGGCCTGTAGTGCGGGGAGAGGGAGCGAGCAGAAGAGGAA GAAGGCCCAAAAGTGAGATCGCCAGAGCAGC | SEQ ID NO: 2748 |
| IKZF1 | ADXCRAD_BM456472_s_at | GTGTGGTGATTGTTCAGGTCGAATCTGTTGTATCCAGTACAGCTTTAGGTCTTCAGCTGCCC TTCTGGCGAGTACATGCACAGGATTGTAAATGAGAAATGCAGTCATATTTCCAGTCTGCCTC TATGATGATGTTAAATTATTGCTGTTTAGCTGTGAACAAGGGATGTACCACTGGAGGAATAG AGTATCCTTTTGTACACATTTT | SEQ ID NO: 2749 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| SP110 | ADXCRAD_NM_080424_s_at | GACTTTGGCCAGGTAGGACTTGACTTAGAGGCAGAATTTGAAAAAGATCTCAAAGACGTGCT CGGTTTTCATGAAGCCAATGACGACGGTTTCTGGACTCTTCCTTGACCCTGTTCTGTAAAGA CTGAAGCATCCCCACCTCAGGATTCAGCTGATGGGACCCTGGCTTGGACTGTTGATTGCCAG TGAGTCTGGGATGTAATTGGCTGCCCTCAGGACCCAAACCCAGACACTTCATAGGATTATCA CACCCTCCATCTTTATT | SEQ ID NO: 2760 |
| SH2D1A | ADXCRAD_NM_002351_at | TCATAATAAGTTGCATAGGTTTAATAATTTTTAATTATATGGCTTGAGTTTAAATTGTAATA GGCGTAACTAATTTTAACTCTATAATGTGTTCATTCTGGAATAATCCTAAACATATGAATTA TGTTTGCATGTTCACTTCCAAGAGC | SEQ ID NO: 2763 |
| SH2D1A | ADXCRAD_NM_002351_x_at | TCATAATAAGTTGCATAGGTTTAATAATTTTTAATTATATGGCTTGAGTTTAAATTGTAATA GGCGTAACTAATTTTAACTCTATAATGTGTTCATTCTGGAATAATCCTAAACATATGAATTA TGTTTGCATGTTCACTTCCAAGAGCCTTTTTTTGAAAAAAAGCTTTTTTTGAATCATCAAGT CTTTCACATTTAA | SEQ ID NO: 2764 |
| CD247 | ADXCRAD_NM_198053_at | AGAGGAGGCCGTTGATTCACTTCACGCTTTCAGCGAATGACAAAATCATCTTTGTGAAGGCC TCGCAGGAAGACCCAACACATGGGACCTATAACTGCCCAGCGGACAGTGGCAGGACAGGAAA AACCCGTCAATGTACTAGGATACTGCTGCGTCATTACAGGGCACAGGCCATGGATGGAAAAC GCTCTCTGCTCTGCTTTTTTTCTACTGTTTTAATTTATACTGGCATGCTAAAGCCTTCCTAT TTTGCATAA | SEQ ID NO: 2773 |
| MFNG | ADXCRAD_NM_002405_at | ACGGGTCCCAGCCAATTGTGATGATCCTTTTTGCTCATTTCCCAGCCTTTCTTGCTGTTAGG GGCTACCATGGGACCAGCTCTGGCCAGAGGGAACTAAGCAAATCCAATAGAGATGTTTCTGG GGAAGGTTTTGCAGCCCACTCCCCATCTTCCTGCTATAAATGTGGGTGTGATGGCTGGATCT GGGGCAGCCACCTTGCTACCAGAAGGAAAGGCCAAGACAATCATCCACAGCTATTCCCTCC AGCATCTGGTTCTGTACAAAAATTA | SEQ ID NO: 2775 |
| CD28 | ADXCRAD_NM_006139_at | TATACAGGGAAGTCCGTTTTCACTATTAGTATGAACCAAGAAATGGTTCAAAAACAGTGGTA GGAGCAATGCTTTCATAGTTTCAGATATGGTAGTTATGAAGAAAACAATGTCATTTGCTGCT ATTATTGTAAGAGTCTTATAATTAATGGTACTCCTATAATTTTTGATTGTGAGCTCACCTAT TTGGGTTAAGCATGCCAATTTAAAGAGACCAAGTGTATGTACATTATGTTCTACA | SEQ ID NO: 2776 |
| 41888 | ADXCRAD_AF403061_s_at | TAATCCATGGCTGTGTACTGAATAGTATTCCCCGCTACAGCTGGACTGGACTCCATTTAGCC TT | SEQ ID NO: 2780 |
| BCL11A | ADXCRAD_BM193618_at | GAAGCTATAGATCTCAAGAGTGCCTGTGTCCTACAAGGAACACATATTTCACAACTGATTCA TTTGCCCCTTACTCTGAGCACATGGGATAATAAAGAAAGTTTTAGATCATCATTATCCAAA GGATAACTTTGAATGCCCTTTTTCAGCATGCTTCTGAAAACATTTCATATCTCATTCAATGC CACATATAAATGGTATTTGCTGGACAGTGTGGAAAACAGAAACATCCGTGCTAAAAGCCAAT GGTAAACACCAAGTTTAAAAAATGGATTGCAAAGATCGCATGTCC | SEQ ID NO: 2785 |
| PAICS | ADXCRAD_AA902652_s_at | TGGACAGCGAACATAAAGCTCTACTAGCTAACAAATAGGTCTTAATGATAAAAACGTGGGCC TTCAGAGAACTAAAGGTACCAATGTGTGGCAGTCCAAAATTACGAGGAAAATGAGTTCCCTT CATGGGTCACATCAGCAATT | SEQ ID NO: 2798 |
| ANP32A | ADXCRAD_T67821_at | TTTAATGAAGATACACCACTGAGTCTTGCTTTAAGACCAAAAATATCCAAACATAGTATCAC ATTATATATATCTCATANGAAAAGCTATTCTATCAGGNAACAAAAATGAAGCTTCCCCCTCA CCTAGCAGTTCATCTGGGAATGCATCTTGAAAAGATCCAATGGCCTGTTGGACTCAAAGAA GCCATCCCCAAAAAAATTGTATAAAAGGGTTTATTGAAATTTATCCAATGACCAACCGG | SEQ ID NO: 2799 |
| ANP32A | ADXCRAD_T67821_x_at | TTTAATGAAGATACACCACTGAGTCTTGCTTTAAGACCAAAAATATCCAAACATAGTATCAC ATTATATATATCTCATANGAAAAGCTATTCTATCAGGNAACAAAAATGAAGCTTCCCCCTCA CCTAGCAGTTCATCTGGGAATGCATCTTGAAAAGATCCAATGGCCTGTTGGACTCAAAGAA GCCATCCCCAAAAAAATTGTATAAAAGGGTTTATTGAAATTTATCCAATGACCAACCGG | SEQ ID NO: 2800 |
| PCBP2 | ADXCRAD_AA504356_at | TGACAGAGTTGGTTTAGGACTAGTGGATGGCATCATGTCAAGTTGTGGATAATGTCACGGGT | SEQ ID NO: 2808 |
| PCBP2 | ADXCRAD_AA504356_s_at | TGTTAGTCCTGGCTAGTCACTCATAACCTATGAATTTAAATTATCTTAGGGCCTCTATTTTT TAATCTGTAAAATGAGGGGATCAATGTGTTACAGATTAGTTGATCCTTAAGGTTCCTTCAA ATCTAAGCATGTCACTTCCTACTCCTGATAGTGCTGGTGGGAGCAGAAAGGATACGGCCAG GAATAGAAAAAGGGTAAAGAAACTTGGTTGACAGAGTTGGTTTAGGACTAGTGGATGGCAT CATGTCAAGTTGTGGATAATGTCACGGGTTGGCTGAGATATAC | SEQ ID NO: 2809 |
| USP7 | ADXCRAD_AI972599_at | TTGGGAACCAAATGGCTCCAAAAGCCATTTGTCCTCCAAGCGACTACAGGGCAAAGTAGTGA GAATCATGCCCATCTCTCTGAAATAAACAATCAATTCAGGGGCTTCTTTCTACAGCCCAAAT GTTGGCTAGATGGAACAGAAGTGACTCAATCTGTCAAATACAAAATCAGGAGTCACCCCTTC CAGTTTCAGTTCATCGTTCAAATGGAATCATATCCTTCCTCTGTTTGGCTTTTCTATGGGAA CTGCGC | SEQ ID NO: 2811 |

TABLE 11-continued

Genes and corresponding Almac probesets predicting sensitivity to oxaliplatin. There can be multiple Almac IDs/probesets associated with a given gene.

| Gene | Almac Probe ID | Probe Sequence | SEQ ID NO |
|---|---|---|---|
| PAICS | ADXCRAD_AU121975_at | TGCTACCACACCCAATTATGAATTTCATCATTAGTTTCTTAGTAGAGTCCACATGTCCTCAGTAGTAAGTTCATCAGTGCTAAATATTT | SEQ ID NO: 2824 |
| PAICS | ADXCRAD_AU121975_x_at | TTAAGAGCCAAGTTCTCACTGTCTCCCAGGCTGGAGTGCAGTGGCATGATTATGGCTCCCTGCAGCCTTGAACTCCTGGACTCAAGCTGCAGCCTCTCGAGTAGCTGGGTGCATGTGCTACCACACCCAATTATGAATTTCATCATTAGTTTCTTAGTAGAGTCCACATGTCCTCAGTAGTAAGTTCATCAGTGCTAAATATTT | SEQ ID NO: 2825 |
| CALML4 | ADXCRAD_AI348378_at | AGATCTTGAAAGTTTTATGTGTTTAAAATTGAAATTGTCTAAAAAATGCTCTTTCCACATTAATTTAGTTAGGATATATTTTCACTCCATTTCAGACACTTGACTCA | SEQ ID NO: 2835 |
| BLM | ADXCRAD_AA769438_at | TAGAGATACAGGAACAAGAGATTTAATATTATTTGAAATAATATTGAATACTGAATAATATCATTGAATATATAATATTGAATATTATTATTTCGGCCAGGTGTGGTGGCTCACGTCTTTAATCTCAGCACTTTGGGAGGCTGAGGGAGGCAGATCACTTGAGCCCAGGAGTTTGAGACTAGCCTGGGCAACACAGGGAGAGCCCATCTCTCTCTCTCTCTTTTTTTTTAAATTCATTACATAAAAACAGATTGGGGCAACGGTTTGTTTATTTACTTGCTTTTGACATCATATTTGC | SEQ ID NO: 2843 |
| BLM | ADXCRAD_AA769438_x_at | GAGATACAGGAACAAGAGATTTAATATTATTTGAAATAATATTGAATACTGAATAATATCATTGAATATATAATATTGAATATTATTATTTCGGCCAGGTGTGGTGGCTCACGTCTTTAATCTCAGCACTTTGGGAGGCTGAGGGAGGCAGATCACTTGAGCCCAGGAGTTTGAGACTAGCCTGGGCAACACAGGGAGAGCCCATCTCTCTCTCTCTCTTTTTTTTTAAATTCATTACATAAAAACAGATTGGGGCAACGGTTTGTTTATTTACTTGCTTTTGACATCATATTTGC | SEQ ID NO: 2844 |
| USH1C | ADXCRAD_NM_025034_at | ACATGCACACATAGGATTTTACTTGAAAAAAATAATAAAGGAGACAGATATGTCAAATCTTTTTCAGGCACTAATAACGTAAATGTAAAAGAACTAGAATCTTCTCCACATACCACCTCCCATCAGAAATCATGTCCTTGAAAGTGCTGTTGATAAAGAAATAGGGTTGCCTTTCCCCTATTCCTTAATCTAATTATTCCAGAAACAGCTGTCATTTTGGTTTTCATT | SEQ ID NO: 2848 |
| CD53 | ADXCRAD_AW293276_at | TTGAACACTCAGTGCTGACCAGAGATTAACATAGGGCATGCAATACTAAAATTGGTTTGCATTTCACTTTCTGCTTCAACGTTCAGTAAATCCATCATAGCCCTACCAAGTGCCAGGGCAGTTGCTGGTCAGTGGTTGTCCTAGTCTTTCTCCACAAACCTGAAAAACCCTGGAGATTTCCAAACCCCTTCAGGAGCAGATAACATGAGGAGACAAGACCTCAGGGATTCAGTCTAGTTGGAAGATAGTTGTGGCTTCTTCTCAGAGCCTATTCTGGAGGTCCAAAT | SEQ ID NO: 2849 |
| HSPD1 | ADXCRAD_AW674195_at | TTTTTATTACACAAAGGTTGTCACATAATTGGATACTTCTCTACTTTGTACACAATTATTCTCACTCTCCACAGAAAGGCTGCTTAACTTCTCATCTGGTGGTGGCAAGCACTAAAATCCTGATTTTAACAGAATAGTAGT | SEQ ID NO: 2850 |
| HSPD1 | ADXCRAD_AW674195_x_at | AATGTTTTACACACATGCCAGCCTGCCCTTCAACTGGCTTTCAATTTTCAGTATCTTCTAATCATGGAAATGCTAACACAATTATTAACTTTAAACAAATTTTTATTACACAAAGGTTGTCACATAATTGGATACTTCTCTACTTTGTACACAATTATTCTCACTCTCCACAGAAAGGCTGCTTAACTTCTCATCTGGTGGTGGCAAGCACTAAAATCCTGATTTTAACAGAATAGTAGT | SEQ ID NO: 2851 |
| ARHGAP15 | ADXCRAD_AI510829_at | GATAAATCTCACACACATACTTCCACTCATACCCACCACATGTATTATATTAGCAATATCATACTCTAGGTCTTCTGGTTTGAGTCAGTATAACATGATAGGCACATTTCTATGGAATTTCATGCATTATTTTCTTTTAATGCTTATGAGGGTAAGTACCAAAATATCCATTTTTCATTCACAGAGTAGAATTATTTTTTGACTTTTTTTGTGATCTTTTGACCAACTCTCACATCCAGAAAATGTGCCATT | SEQ ID NO: 2854 |
| RNPS1 | ADXCRAD_NM_006711_at | AATAAACCCAAGATCATCTGAGATGAATATTAATTTTATTCTCATTTTATAGATGAGGAAATGGGAGTTTTAAAGACATTCAATAACTTTGGCCAAGGTCATTCAGCTATTAAATTTTAAGACCATAAACCAATTGGATTCCTGGAGGAATTC | SEQ ID NO: 2859 |
| PAICS | ADXCRAD_AB002325_x_at | GTTGCAGTGAGCCTCGATCCTGTCACTGCACTCCA | SEQ ID NO: 2861 |
| THUMPD1 | ADXCRAD_AL134904_at | CAGCTTGTGTAACAACCGATTCTTACCAAATACAAATAAATATAAAAGACAACTTAAAAACAAACTGTATAATCAAAATCTTTCCGTAAAATAGCAGCTTTCACAAAGTAAAAACAATTTAGTTCCACAGAGTTGTATGCTCTGTAGGCATATGGCCAATTTTCTTCCGAGTCCTT | SEQ ID NO: 2878 |
| THUMPD1 | ADXCRAD_AL134904_x_at | CAGGTTACAACCGAACACAGGATTTTGTAACTGGGAAAGAACAGCTTGTGTAACAACCGATTCTTACCAAATACAAATAAATATAAAAGACAACTTAAAAACAAACTGTATAATCAAAATCTTTCCGTAAAATAGCAGCTTTCACAAAGTAAAAACAATTTAGTTCCACAGAGTTGTATGCTCTGTAGGCATATGGCCAATTTTCTTCCGAGTCCTTTTGTCTTGCACTATCAA | SEQ ID NO: 2879 |
| CALML4 | ADXCRAD_AW025529_at | ACCGCAGGTCGGACGCCATGACGTAACCTTTCTTCTCCTTGTCCACCATCAACATGGCTAGAAGAAATTTCTTTCTTTGGGTCTTCTTGTTTTATTTGCATGTGCATAATGGTCAGAAAAGTGGAGAAATCCAGCTCTCCATTTCCGTCTATCCCGTGGGTCTGCAGGTGCCGCTGCACCTCCCCTGGCGTTGGGCTGGCCCCCAGGCACCTCATGGCCACCATGAGGTCGGGGGCTTTATCTTCCCCCTCTGCTGCTGTCATACAAGGAGAAGCATTTCTTGTCTCATTAATTT | SEQ ID NO: 2902 |

TABLE 12

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| ACTB | AFFX-HSAC07/X00351_5_at | TGATATCGCCGCGCTCGTCGTCGACAACGGCTCCGGCATGTGCAAGGCCGGCTTCGCGGG CGACGATGCCCCCCGGGCCGTCTTCCCCTCCATCGTGGGGCGCCCCAGGCACCAGGGCGT GATGGTGGGCATGGGTCAGAAGGATTCCTATGTGGGCGACGAGGCCCAGAGCAAGAGAGG CATCCTCACCCTGAAGTACCCCATCGAGCACGGCATCGTCACCAACTGGGACGACATGGA GAAAATCTGGCACCACACCTTCTACAATGAGCTGCGTGTGGCTCCCGAGGAGCACCCCGT GCTGCTGACCGAGGCCCCCCTGAACCCCAAGGCCAACCGCGAGAAGATGACCCAGATCAT GTTTGAGACCTTCAACACCCCAGCCATGTACGTTGCTATCCAGGCTGTGCTATCCCTGTA CGCCTCTGGCCGTACCACTGGCATCGTGATGGACTCCGGTGACGGGGTCACCCACACTGT GCCCATCTACGAGGGGTATGCCCTCCCCCATGCCATCCTGCGTCTGGACCTGGCT | SEQ ID NO: 827 |
| ACTB | AFFX-HSAC07/X00351_M_at | ACCACGGCCGAGCGGGAAATCGTGCGTGACATTAAGGAGAAGCTGTGCTACGTCGCCCTG GACTTCGAGCAAGAGATGGCCACGGCTGCTTCCAGCTCCTCCCTGGAGAAGAGCTACGAG CTGCCTGACGGCCAGGTCATCACCATTGGCAATGAGCGGTTCCGCTGCCCTGAGGCACTC TTCCAGCCTTCCTTCCTGGGCATGGAGTCCTGTGGCATCCACGAAACTACCTTCAACTCC ATCATGAAGTGTGACGTGGACATCCGCAAAGACCTGTACGCCAACACAGTGCTGTCTGGC GGCACCACCATGTACCCTGGCATTGCCGACAGGATGCAGAAGGAGATCACTGCCCTGGCA CCCAGCACAATGAAGATCAAGATCATTGCTCCTCCTGAGCGCAAGTACTCCGTGTGGATC GGCGGCTCCATCCTGGCCTCGCTGTCCACCTTCCAGCAGATGTGGATCAGCAAGCAGGAG TATGACGAGTCCGGCCCCTCCATCGTCCACCGCAAATGCTTCTAGGCGG | SEQ ID NO: 828 |
| ACTB | AFFX-HSAC07/X00351_3_at | TCTTGACAAAACCTAACTTGCGCAGAAAACAAGATGAGATTGGCATGGCTTTATTTGTTT TTTTTGTTTTGTTTTGGTTTTTTTTTTTTTTGGCTTGACTCAGGATTTAAAAACTGGA ACGGTGAAGGTGACAGCAGTCGGTTGGAGCGAGCATCCCCCAAAGTTCACAATGTGGCCG AGGCTTTGATTGCACATTGTTGTTTTTTAATAGTCATTCCAAATATGAGATGCATTGT TACAGGAAGTCCCTTGCCATCCTAAAAGCCACCCCACTTCTCTCTAAGGAGAATGGCCCA GTCCTCTCCCAAGTCCACACAGGGGAGGTGATAGCATTGCTTTCGTGTAAATTATGTAAT GCAAAATTTTTTAATCTTCGCCTTAATACTTTTTATTTTGTTTTATTTTGAATGATGA GCCTTCGTGCCCCCCCTTCCCCTTTTTGTCCCCAACTTGAGATGTATGAAGGCTTTTG GTCTCCCTGGGAGTGGGTGGAGGCAGCCAGGGCTTACCTGTACACTGACTTGAGACCA | SEQ ID NO: 829 |
| CRIM1 | ADXCRAG_AC007401_at | GGGCAGAAAAGCCATGTCGCCATTTACTTGACACCTTTCAGTGCCACACACACCCTTCTG CCCCTCCCCTGCCTAGTCCAGGGCTTCACACTGAGCCTTCCTATGACAATAGGGGCCGAA CTGCCACTGGTTTCTGAGGCCTCAGTGTGGAAGGGCAAATGCGACACCAATTCCAACAAC CTGTAAATGTCAATGGCTAAGTAGTAAAAGTTTCTGCAGAGGCCCCAGAGCTGGGATTGA TTCAGTTCCACCTCAGGTTTTTTCCTGAGTGAGAGGGAGAGACGTAACTTTGGAAT | SEQ ID NO: 842 |
| RRBP1 | ADXCRAG_AF006751_s_at | AGAAGAAGTTAACAAGTGACCTGGGGCGCGCCGCCACGAGACTGCAGGAGCTTCTGAAGA CGACCCAGGAGCAGCTGGCAAGGGAGAAGGACACGGTGAAGAAGCTGCAGGAACAGCTGG AAAAGGCAGAGGACGGCAGCAGCTCAAAGGAGGGCACCTCTGT | SEQ ID NO: 843 |
| CDC14B | ADXCRAG_AF023158_s_at | CATTGACGTGGCCTGCGATCTCAGTGACAATGATCTGCTTTCTGGATCTCACTGTTGCCT TTGGTTAGGGAACACAGAGTGCTTCTCCCGCAGCCCTACTGGAACACAGCAGAGTCTGTG CCATGAAGCAGTTACAGAAACAGAATTGAT | SEQ ID NO: 845 |
| SVIL | ADXCRAD_CA396083_s_at | GAAGCTTGAGATCTATCTCACCGACGAAGACTTCGAGTTTGCACTAGACATGACGAGGGA TGAATACAACGCCCTGCCCGCCTGGAAGCAGGTGAACCTGAAGAAAGCAAAAGGCCTGTT CTGAGTGGGGAGACGCCAGAGGAGCCTCACGGTCACGTCCAACAACACCACTGCACCAGG GAAATGGATAT | SEQ ID NO: 846 |
| CDC14B | ADXCRAG_AF064104_at | GTGTGTCAGATGGAGAGATCCCCTTAACCTAAGAGCCTTAAATAGCCCTGAAAGTACACT GGGACGGTTTGCGATGGAATTAAAATTGGAAGTGAATATTTTAGGTGCTCTTGAAGCTT TCTGGGGACTCAAAATTATCAAAAGTCAGGGACAGTCCGGAGGAAGAGCGTCTGCAAAAC TGGGTTCCTAGAAGTATAGACGGACTTAGCTTTTTGTAGAATTTGGTGAGGAGCAGCGCC TCGTGAGAGCAGAATGGCCTGGCGTGGCCAGTGCTTC | SEQ ID NO: 847 |
| CDC14B | ADXCRAG_AF064105_at | AATTTCTTGGTCTCCGAAAACTCAGCTGTGACTGCTTTCCATTAACAGTTCCAGCTCTAT GTGTTTCCTCTAACGCTAAAGGCACAGCCCCGGGAATCTACTGCTTCCTAAGAGTCTCC ATGGAGTCTATTTTACAACCTCCTTTCCCTCCATGCTTCCGCGGAGGAGTCTATACTATC TCTATAT | SEQ ID NO: 848 |
| LOXL2 | ADXCRAG_AF117949_s_at | GAAACTTGTCAGAAGGCATAGGAGTTGTGCGAGGGCTGGATGGGAAGTCTAGATTTAAAC AGCCACCAGGCAGCTTATCAAAGCAAGAGGGCATCCGTTCACAGGACAGGGGCTCCCAGC AATTCCCAGTGGCAGTGGGGGGTGGCTGGCCCAAGCCCCAAGTCACCCAGACACAGGGGA CTTCCCCCTTGTGTCAACAGCATGCTAGGGCCCAGCAAACTAGAGGGTAGGTAGGACCACC TTGGCACCAA | SEQ ID NO: 858 |
| FOXN3 | ADXCRAG_AF138861_s_at | GGTTCATTTTAGTTTCAGATAGATGGCTTCACCAAAGAACTCTTGAAGAATACTGATTA GGGAGGGGCAGGGAAGTAGGAGCTTATGGTATATTATAAGGCTGGGAAAAATCTATGATG CAAACCCTTTCCACATAGTACT | SEQ ID NO: 865 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| YPEL5 | ADXCRAD_CD103546_s_at | GACTTCTGAGTACAGTTAAGTTCCTCCTATTTGCCACTGGGCTGTTGGTTAGAAGCATAG GTAACTGATTAAGTAGGTATGATACTGCATTTGAAATAAGTGGACACAAACTATCCTTTC TCCACCATGGACTCAATCTGAGAACAACAGCATTCATTTCCATTCATTTCCATACTGGCT TTTGATTATATGCAGATTCCTAGTAGCATGCCTTACCTACAGCACTATGTGCATTTGCTG TCACAATAAAGTA | SEQ ID NO: 868 |
| CRIM1 | ADXCRAG_AF168681_x_at | ACTAATGATAATCCATCTCCCTTCGCTGACTCTCTTTTCGGACTCAGCCCGCCTGCATCC AGGTGAAATAAACAGCCGTGTTGCTCACACAAAGCCTGTTTGGTGGTCTCTTCACACGGA CGCACATGAAATTTGGTGCCGTGACTCGGATCGGGGGACCTCCCTTGGGAGATCAATCCC CCTGTCCTCCTGCTCTTTGCTCCATGAGAAAGATCCACCTACGACCTCAGGTCCTCAGAC CGACCAGCCCAAAAAACAT | SEQ ID NO: 869 |
| DKK1 | ADXCRAG_AF177394_s_at | GTTATCTTGACTGACAAATATTCTATATTGAACTGAAGTAAATCATTTCAGCTTATAGTT CTTAAAAGCATAACCCTTTACCCCATTTAATTCTAGAGTCTAGAACGCAAGGATCTCTTG GAATGACAAATGATAGGTACCTAAAATGTAACATGAAAATACTAGCTTATTTTCTGAAAT GTACTATCTTAATGCTTAAATTATATTTCCCTTTAGGCTGTGATAGTTTTTG | SEQ ID NO: 870 |
| MAP7D1 | ADXCRPD.6828.C1_s_at | TTGCCTTGATTTGGTGGGGTACAGTGGATGTGAATACTGTAAATAGCTTGTGCTCAGACT CCTCTGCGTGGAGGGGTGGGTGCAGGAGGCAGACCCTCCCCCCAAAGCCCCCTGGGGAG ATCTTCCTCTCTCTATTTAACTGTAACTGAGGG | SEQ ID NO: 871 |
| CAV2 | ADXCRAG_AF260225_at | GAAAATAGCAATGTGCTGCTCTAAGCATTAGAGGTTCCCAAGTCTGCGCTTCAGAATGGG ATTATCTGGGAAACCTGGTAGAGAAGACAGTTTGTTTTTTCTTTTTAAAAAGTGTTGAGCT GTGGTTTAGGGTATTAAATAATAAAAACTCATCTCTATTTTCCATATCCACATATTTATA ATATTTTACTCTTTATGGGCAAAAATTTATTCTTTCAAACCACCCCCTACTATGCCTCAA CATGTCTATTACATTAAAATTATCTCATATGTAGAGCAAG | SEQ ID NO: 874 |
| SYNJ2 | ADXCRAG_AF318616_s_at | CTTGCAGTGCTGGAAATAGATCTCATTTTTAGGTTTTCTCTTCGTTCCAGATACCAAATA AATGGGACAGAGAATAAAATTTTGTTAAAATATGTGCTCATCTCCTAAGTAGCTCTTCA GAGTCTGACCGTAAGTAAAAACACACAGAATTGTGTTGACTGGGGAGGTGAATCACAAA AAAGTTACGAGGAGTTTAAGAGTTAAATATTATTTGATCGTGGCTGTCAAATTTAGTGAA C | SEQ ID NO: 875 |
| PPAP2B | ADXCRAG_AF480883_at | GCTCGTAACACAACTCTCATCTCAGGCTCTTCTAAAGAGCTTTTGTATTCTAAAGAGGAT TTTTCCATCAGAGAGGTAGGAGCTGTAGGAACCCCGAGGGCAGATAAGCAGCCCTCACTC TAGATAAGGTATGCTGGGGGAGCTTACTGAGGGAATCCTGTACACAGCCCACATCAAAGG AAGGCTGAGAATGGCCTGTGGCTCC | SEQ ID NO: 878 |
| TXNRD1 | ADXCRAG_AJ001050_s_at | CAAGTCCACCAGTCTCTGAAATTAGAACAGTAGGCACGGTATGAGATAATCAGGCCTAAT CATGTTGTGATTCTCTTTTCTTAGTGGAGTGGAATGTTCTATCCCCACAAGAAGGATTAT ATCTTATAGACTTGTCTTGTTCAGATTCTGTATTTACCCATTTTATTGAAACATATACTA AGTTCCATGTAT | SEQ ID NO: 880 |
| COL6A2 | ADXCRAD_CV571242_s_at | GAGTCGGCGCACTCCATGCGCAAGCAGAACGTGGTACCCACCGTGCTGGCCTTGGGCAGC GACGTGGACATGGACGTGCTCACCACGCTCAGCCTGGGTGACCGCGCCGCCGTGTTCAC GAGAAGGACTATGACAGCCTGGCGCAACCCGGCTTCTTCGACCGCTTCATCCGCTGGATC TGCTAGCGCCGCCGCCCGGGCCCCGCAGTCGAGGGTCGTGAGCCCACCCCGTCCATGGTG CTAAGCGGGCCCGGGT | SEQ ID NO: 887 |
| PRSS23 | ADXCRAG_AL832007_at | AAAATAGGCAACCAGAAGCCTTCTGTCAGTGGAGTAGCCATTC | SEQ ID NO: 891 |
| PRSS23 | ADXCRAG_AL832007_x_at | AGAAGCCAGCTGAAGCCCACCAAAACCAAGATGGCCATGAGAGTGACCTCTGGTTGTCCT CACTGCTACACTCCACCAGCACCATGACAGTTTACAGATGCCATGGCAATGTCAGGAAG TTACCCTATATGGTCTAAAAGGGGAGGCATGAATAATCCACCCCTTGTTTAGCATATAAT CAAGAAATAACCATAAAAATAGGCAACCAGAAGCCTTCTGTCAGTGGAGTAGCCATTCT | SEQ ID NO: 892 |
| WDR1 | ADXCRAG_AL832280_at | ATTAGTTCCCCACGGAGAAGGGATGGATAGTCTGTGCTTCGGGGGTCTAAGGAAGGCTTC CTGCAGGTGCTGGTACCTCCTTAGGTCTGGGGTGGTTCCTTCTAAGTTTCCTTACCCTGC CTGCATCCACCTCTGCCTCTTATGACCTCTGTGCAAAGACTGGGAAGGGTCACCCCCAATG GCTGTGAACGAACCTGTTTGTGATTCTAAACAGGGCACGGGACCCATCCTACAATAAAAT TACCCAGCCTAAAATGCCAGTAGTGCCAGTAGTCCCTGTTTAGAA | SEQ ID NO: 894 |
| CAST | ADXCRAD_BE538471_s_at | AAATATCTTCGAGACTTGGGTGTTTGTTAATAACTAATAACTGGAGTAAGCTACAGGATC TAAAGCAGCCCTTTTTTACAGTCTAGTTAGGAGAGAGAAAATAATTGCAAATATCCACTTA GAGGCAAAGAAC | SEQ ID NO: 895 |
| FLNB | ADXCRAG_AL833551_at | GTCAGGGACGTTGCCTGGGCCCAAATGTGTAGTGTGGTCTGGGCAGGCAGACCTTTAGGT TTTGCTCTTAGTCCTGAGGAAGTGGCCACTCTTGTGGCAGGTGTAGTATCTGGGCGAG TGTTGGGGGTAAAAGCCCACCCTACAGAAAGTGGAACAGCCCGGAGCCTGATGTGAAAGG ACCACGGGTGTTGTAAGCTGGGACACGGAAGCCAAACTGGAATCAAACGCCGACTGTAAA TTGTATCTT | SEQ ID NO: 900 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| PLAUR | ADXCRAG_AY194849_at | AAATGCAAGCTTCCAGATCACACACTGAACACTAACCTTCTAGTCTTCTCCTAAACTTCA AAGGTTGCAACTATTTTGTTGTTCTAAGGAGACATCCCCACATTTCCCAGCATGCTTTGG GAAAGGAGACGGATAGAAGATAACCTGATGGCCAGAACTCCCTGCATGCACTGCAGTGAG GAATAAGGACAGGAGTGCACTTCCCCTGATGTGCTGGGGACCGGGGATAAAGGCTGGGCT CTATTTCCCGGGATGCCTCAGGACTGTCAGAAAAAGAGACAGAACTACCATTTCAATGGC | SEQ ID NO: 903 |
| RYBP | ADXCRAG_AY228125_s_at | TTGTGAAAACTATGAATCAGGGTATGAAATTCAAAACCTCCACCTGCCCATGCTGCTTGC ATCCCTGGAGAATCTTCTGTGGACATCGACCTCTTAGTGATGCTGCCAGGATAATTTCTG CTTGCCATGGGCATCTGGCCACCAAGGAATTTCGCACCCTGACGATTACTCTTGACACTT TTATGTATTCCATTGTTTTATATGATTTTCCTAACAATC | SEQ ID NO: 904 |
| NFIB | ADXCRAG_BC001283_s_at | CATGATAAGCTAGTTTTATTGGTTTAGTATTCTTGTTGTTTACGCATGGAATCACTATTC CTGGTTATCTCACCAACGAAGGCTAGGAGGCGGCGTCAGAGGTGCTGGGTGACAGAGCCA TGAGCCAGCCATTTTATAAGCACTCTGATTTCTAAAAGTTAAAAAAAATATATGAAATCT CTGTAGCCTTTAGTTATCAGTACAGATTTATTAAATTTCGGCCCTTAACCCAGCCTTTTC CAGTGTGTAACCCAGTTTGA | SEQ ID NO: 913 |
| TPM4 | ADXCRPD.6315.C1_s_at | ATGGCACCAGCTTTTTCAGCTCTCTTATTTTTTCCTTAAGTAGCATTTATTCCTAAGGTA GGCAGGGTATTTCCTAGTAAGCATACTTTCTTAAGACGGAGGCCATTTGGTTCCTGGGAG AATAGGCAGCCCCACACTTTGAAGAATACAGACCCCAGTATCTAGTCGTGGATATAATTA AAACGCTGAAGACCATAACCTTTTGGGTCAACTGTTGGTCAAACTATAG | SEQ ID NO: 917 |
| FKBP9 | ADXCRAD_CD251162_s_at | GCAGAGGCCAGCTGCCGCAAGACAGCAATGACAGTCCACCTGCCGACCTGATTCCTGCAT CATGGAATAACCACATGGCTACCTTCTATCCTCTGTTCCCAAATGGTGGTGGCACTTATC CTGAAGTCGTCAATGATTTCCCTTTGAAACTACTTTATTTTACTAATTTAAACTATTTTG TACTGATGTAGCCCTGAGGTAGTTCATGAAAATGCTGTGCACTCATTCCATGGAATAAAT GTTGGAAAGCTGATCTTTTCTGATATAA | SEQ ID NO: 923 |
| ITGA5 | ADXCRAD_W52075_s_at | GGAGGCCCAGTTCACCCTGATTTAGGAGAAGCCAGGAATTTCCCAGGACCCTGAAGGGGC CATGATGGCAACAGATCTGGAACCTCAGCCTGGCCAGACACAGGCCCTCCCTGTTCCCCA GAGAAAGGGGAGCCCACTGTCCTGGGCCTGCAGAATTTGGGTTCTGCCTGCCAGCTGCAC TGATGCTGCCCCTCATCTCTCTGCCCAACCCTTCCCNCACCTTGGCACCAGACACCCAGG ACTTATTTAA | SEQ ID NO: 926 |
| MVP | ADXCRAG_BC008932_s_at | GAGATGCAGGTAAAACTGCTCCAGTCCCTGGGCCTGAAATCAACCCTCATCACCGATGGC TCCACTCCCATCAACCTCTTCAACACAGCCTTTGGGCTGCTGGGGATGGGGCCCGAGGGT CAGCCCCTGGGCAGAAGGGTGGCCAGTGGGCCCAGCCCTGGGGAGGGGATATCCCCCCAG TCTGCTCAGGCCCCTCAAGCTCCTGGAGACAACCACGTGGTGCCTGTACTGCGCTAACTC CTGATTAATACAATG | SEQ ID NO: 927 |
| RRBP1 | ADXCRAG_BC009700_x_at | ACTCAGAATCAAAGCAAAAAGGCTGAAGGAGCCCCAAACCAGGGCAGAAAGGCAGAGGGA ACCCCAAACCAGGGCAAAAAGACAGAGGGAACCCCAAACCAAGGGAAAAAGGCAGAGGGA ACCCCAAACCAAGGCAAAAAGGCAGAAGGAACCCCAAACCAAGGCAAAAAGGCGGAGGGG GCCCAGAACCAGGGTAAAAAGGTAGATACAACCCCAAACCAGGGGAAAAAGGTGGAGGGG GCCCCAACCCAGGGCAGAAAGGCCGAGGGGGCTCAGAACCAGGCCAAAA | SEQ ID NO: 928 |
| AMOTL2 | ADXCRAG_BC011454_s_at | TCAGCCCCAGGAGCTATTGGTGGGTTTTAGCAGTTTTGTCTTTACCGTTTTTAGTTCTCC TTGATTCTTTGTTTTCTTCCTTTATCGTTTTTAGGTTTGGTATGTGTTGTTTTATTTCCA TGGTTCCTCAAGTTTCCTTTTTAAACATTTGCATTTGCTGGACAATTGCAATTTTTTTA | SEQ ID NO: 930 |
| RNH1 | ADXCRAG_BC011500_s_at | GCCATGCTCTCACCCTGCATATCCTAGGTTTGAAGAGAAACGCTCAGATCCGCTTATTTC TGCCAG | SEQ ID NO: 931 |
| ACTN1 | ADXCRAG_BC011987_s_at | GGAAAGATTAACTATTTGCACCGAAATGTCTTGTTTTGTTGCGACATAGGAAAATAACCA AGCACAAAGTTATATTCCATCCTTTTTACTGATTTTTTTTCTTCTATCTGTTCCATCTG CTGTATTCATTTCTCCAATCTCATGTCCATTTTGGTGTGGGAGTCGGGGTAGGGGTACT CTTGTCAAAAGGCACATTGGTGCATGTGTGTTTGCTAGCTCACTTGTCCATGAAAATATT T | SEQ ID NO: 934 |
| CYP1B1 | ADXCRAG_BC012049_s_at | TTCAGGAAAATAACTTAGACTCTAGTATTTATGGGTGGATTTATCCTTTTGCCTTCTGGT ATACTTCCTTACTTTTAAGGATAAATCATAAAGTCAGTTGCTCAAAAAGAAATCAATAGT TGAATTAGTGAGTATAGTGGGGTTCCATGAGTTATCATGAATTTTAAAGTATGCATTATT AAATTGTAAAACTCCAAGGTGATGTTGTACCTC | SEQ ID NO: 935 |
| TMBIM1 | ADXCRAG_BC013428_at | GGTCCTAAGAGGAAGGTGACTTCTCTCTGTTTGTCTTAAGTTGCACTGGGGGATTCTGAA CTTGAGGCCCATCTCTCCAGCCAGCCACTGCCTTCTTTGTAATATTAAGTGCCTTGAGCT GGAATGGGAAGGGGACAAGGGTCAGTCTGTCGGGTGGGGGCAGAAATCAAATCAGCCC AAGGATATAGTTAGGATTAATTACTTAATAGAGAAATCCTAACTATATCACACAAAGGGA TACAACTATAAA | SEQ ID NO: 937 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| MAPK1 | ADXCRAD_CF143752_s_at | TAAGGTGCCATGGAACAGGCTGTTCCCAAATGCTGACTCCAAAGCTCTGGACTTATTGGA CAAAATGTTGACATTCAACCCACACAAGAGGATTGAAGTAGAACAGGCTCTGGCCCACCC ATATCTGGAGCAGTATTACGACCCGAGTGACGAGCCCATCGCCGAAGCACCATTCAAGTT CGACATGGAAT | SEQ ID NO: 943 |
| PLAUR | ADXCRAG_BC019258_x_at | CAAGTGATCTGTACATCTCAGCTACTCAGGAGGTTGAGTCAGGGGAACCTCTTGAACCC | SEQ ID NO: 946 |
| ADAM9 | ADXCRAG_BC027996_s_at | TGGCTTTTGTTGGTTGTTGGATTGACTGTGATTTAAAATGTTAAAGATGATATAATGCAT CTTGTTCTGCTTCTAGGCTGAAAGGTCACTGAGGCAGAGCTGTTTGTACCTTGTATCCCC TGGAATTTTGCCTAAACATTTGTGTACTCATAGGGTGGTAGGAGATAGTCCGCAGATGGT CTAAAGAATGCCATGTGATACTGTGAGATGCCAAT | SEQ ID NO: 952 |
| VIM | ADXCRAD_AL046837_s_at | TTTTAAACTTGGCTGTATTGTGTACAACTATTATACCATCTTTTATAAACACAGTTTTTT AAGAAATTTCTTTTTGTAAGTTACAACATTCCACTGGATCCTTATATTGCCTGTAGTGGA AGAGGGTCTTGTGTGTCTGCCCCTTCTAGTTTTCACTCATGCAGAAGCAACATAACCTTC TGATTTGCACAATAAAATNACATATATTTAGCAGGATTTTTATTTGCCGTGATATATAGGA TAATTTAGTCTTTGGCATGTGGC | SEQ ID NO: 953 |
| TPBG | ADXCRAG_BC037161_s_at | TATTCTCATGTACCTAAGTTGTGGAGAAAATAATTGCATCCTATAAACTGCCTGCAGACG TTAGCAGGCTCTTCAAATAACTCCATGGTGCACAGGAGCACCTGCATCCAAGAGCATGC TTACATTTTACTGTTCTGCATATTACAAAAATAACTTGCAACTTCATAACTTCTTTGAC AAAGTAAATTACTTTTTTGATTGCAGTTTATATGAAAATGTACTGATTTTTTTTAATAA ACTGCATCGAGATCCAACCGACTGAATTGTTAA | SEQ ID NO: 958 |
| FNDC3B | ADXCRAG_BC039297_s_at | AACACAGACTACAGGTTCCGCGTATGTGCGTGTCGTCGCTGTTTAGACACCTCTCAGGAG CTAAGCGGAGCCTTCAGCCCCTCTGCGGCTTTTGTATTACAACGAAGTGAGGTCATGCTT ACAGGGGACATGGGGAGCTTAGATGATCCCAAAATGAAGAGCATGATGCCTACTGATGAA CAGTTTCAGCCATCATTGTGCTTGGCTTTGCAACTTTGTCCATTTTATTTGCCTTTATA TTACAGTACTTCTTA | SEQ ID NO: 961 |
| GALNT2 | ADXCRAG_BC041120_s_at | AGAGCCCTTCGAGCAAAGCGTGCCGAAGTTAGTTGTCTTCTCTGTGGTGGTCCTTTCTTA TGTCCTCATAAAAGCTCAGATGATGGTATCTGTGAGTATGTTTTGCAAATTCAAAATATA GTTTGGTAATTTTTTTTTCCAGTTGATTTTTAAAAAGAACTGCTGTACAGAGCTTGT | SEQ ID NO: 964 |
| ALCAM | ADXCRAG_BC041127_s_at | TTGGAATAATTATAGTCACTATGACAAAATTACTTTGCCTAATGATAGCATATAGTTAAT GTTACTGTGCAAATAACTGTGCAAATGAATGACTTGAGAAGT | SEQ ID NO: 965 |
| MAP1B | ADXCRAG_BC046114_s_at | TTCAGTGACTGAAAAGGAGGTTCCCAGCAAAGAAGAGCCATCTCCAGTGAAAGCCGAGGT GGCTGAGAAGCAAGCCACAGATGTCAAACCCAAAGCTGCCAAGGAGAAGACGGTGAAAAA GGAAACAAAGGTAAAGCCTGAAGACA | SEQ ID NO: 967 |
| AMIGO2 | ADXCRAG_BC047595_s_at | GTGTCAATACCAAAATGTCTGAGTAACTTCTTAAATCCCTGTTCTAGCAAACTAATATTG GTTCATGTGCTTGTGTATATGTAAATCTTAAATTATGTGAACTATTAAATAGACCCTACT GTACTGTGCTTTGGACATTTGAATTAATGTAAATATATGTAATCTGTGACTTGATATTTT GTTTTATTTGGCTATTTAAAAACATAAATCTAAAATGTCTTATGTTATCAGATTATGCTA TTTTTGTATAAAGCACCACTGATAGCA | SEQ ID NO: 968 |
| CDC42BPA | ADXCRAG_BC050335_x_at | GGGAAGATACTGCTTTAGCCTATCACTCCTTATTTTATTTTGTTTGGTTTTATGCCCTCA GTGTCTTAGGGAACTTTTTAAGAGATCCTCTGCTACCAAACAATGATGTGGATTCTTTTG CACAGAAATATTTAAGGTGGGATGGTAAAAAATGTCACAAAAGACTCCTCACCAATACTT TATGTTGATATCACTTAATATTAACCAGACTTTGCTGTATTGCAATA | SEQ ID NO: 971 |
| MICALL1 | ADXCRAG_BK000466_s_at | AGCTGGTGGGTTTTGCCCAAGAAAGGTCACGCGGCACATGCAGGGATTGGAACTCCCAGG CCAGGGCTCTAGGTCGCTCCCACCTTTTCATGTTTCTTTCTGTGGCCATGGGTATAGTGG AAAGACATAAAGCTAAAGCCAACTTTTAATCCTGAATGCACTGCTTGCCAGGTAAATGCC CTTGGTTGTGGTATCTTGTTGAGACTTAGTTTTCACAGAGGGATAATGAACCGTTGCAGA GGTTTATTGAGATCATT | SEQ ID NO: 977 |
| LPP | ADXCRAG_BX648297_s_at | GTAGGGTATGACTTGTGAGTCCACAAGGCCAGCAGTATATATGCTGAATGGACTGCTTAG CAGTAACACACTGGAAAAATCCAAAAAGAATGGATTTCAAGTTGGCAAAAAATGCATTAG AAGTCAGCAGTGTGATGTGGTCAGGAGAACAACCAGAGTGACTGTGGGATGAGGTCTTGG ATAGCTTTGTT | SEQ ID NO: 984 |
| CDH11 | ADXCRAG_D21254_s_at | TTGTTACTGCTGATTCTTGTAAATCTTTTTGCTTCTACTTTCATCTTAAACTAATACGTG CCAGATATAACTGTCTTGTTTCAGTGAGAGACGCCCTATTTCTATGTC | SEQ ID NO: 986 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| TRAM2 | ADXCRAD_BM789115_s_at | TGGTGCCCTGAGCAACTGATAATGCAAATGTGGACAAAGTGTCTGTTTTCTACTCTAGCC TGTTCATATGGACCAAATTTCAACAAGGAACTCAAGGAAAATTTGTACCTGCCGTATTTA TGCTTTCATGTAAAAAAGGGTTGGGGGGAGGGGTGTCTTTTTGCTTTTGGTGAACTTTTT TTCAAAATCATTTTTCCACTGTTTCTGTCTGGTTTTAAAACAAATTACAGTTTTGTATGG ATTTT | SEQ ID NO: 988 |
| VCAN | ADXCRAG_D32039_s_at | GAAAATGCCAAGACCTTTGGAAAGATGAAACCTCGTTATGAAATCAACTCCCTGATTAGA TACCACTGCAAAGATGGTTTCATTCAACGTCACCTTCCAACTATCCGGTGCTTAGGAAAT GGAAGATGGGCTATACCTAAAATTACCTGCATGAACCCATCTGCATACCAAAGGACTTAT TC | SEQ ID NO: 989 |
| DNAJB1 | ADXCRAG_D85429_at | GTGTCTCACAAAAAAGTGTCAAGCTAAGAGTTGCTTTCCCTTCCCACTGAAACAGTTGAA GCGCTGAAAACAGGCTAGGGGCAGCCCTGCCAGTCCAGGAGAACTTTCTGCAATGACTAG AACGTTCTATATACCGTTTACTTAAACATCTTACAAATTCAATAAAATTAGAATCAGTTC CTCAGTCCTGCCACACTTCAGTTGCTTAGCAGCCACACATGTATGTGGCCAGTGGCAACT GTTGGACAAGTCAAGT | SEQ ID NO: 990 |
| MAP1B | ADXCRAG_L06237_at | AAGAGCCAAGTTCAAAGAACCCTAGCACAAATTTGCTTTGGGATT | SEQ ID NO: 991 |
| MAP1B | ADXCRAD_BX643299_s_at | GAAGTTCTGGCAAGATTGAAGTCTGATATTGCAGTAATGATATTTATTAAAAACCCATAA CTACCAGGAATAATGATACCTCCCACCCCTTGATTCCCATAACATAAAAGTGCTACTTGA GAGTGGGGGAGAATGGCATGGTAGGCTACTTTTCAGGGCCTTGACAAGTACATCACCCAG NGGTATCCTACATACTTCTTTCAAGA | SEQ ID NO: 992 |
| JAK1 | ADXCRAG_M64174_s_at | ATGAGCTGCTGACTTACTGTGATTCAGATTCTAGTCCCATGGCTTTGTTCCTGAAAATGA TAGGCCCAACCCATGGCCAGATGACAGTCACAAGACTTGTGAATACGTTAAAAGAAGGAA AACGCCTGCCGTGCCCACCTAACTGTCCAGATGAGGTTTATCAGCTTATGAGAAAATGCT GGGAATTCCAACCATCCAATCGGACAAGCTTTCAGAACCTTATTGA | SEQ ID NO: 996 |
| AHNAK | ADXCRAG_M80899_s_at | TCTAGCAATGACAGTGGGAATAAGGTTGGCATCCAGCTTCCCGAGGTGGAGCTGTCAGTT TCCACAAAGAAAGAGTAGCAGGCCTTTGTATGTGTGTACATATATATATATATAACAAAA CATCAGCCTTGGGTGGTGTGTTCCTATATAAACTCCAAAGGGAAACACACCGACTGCCTC AGCAATCATGCAAAGA | SEQ ID NO: 999 |
| KRT14 | ADXCRAG_NG_002781_at | ACCAGGTCATATGTGGCGTCTCCTAGGGTACAGAGAGATATTCATTCATTTCCTCACTCA TTTTCATGTGTGTCCATTCATTCACCAGATATTGAGTGCCGCTATGTCAGGCACTATGTT AGGTTAAGGATTCCTAATGTTTTTGTGATCAGGGATTCCTTGGAGAATATTGAAAGCTAT AGATCTTTCCTTCTGCCCCTACCTTCAAATAAGCA | SEQ ID NO: 1000 |
| COL5A2 | ADXCRAD_CK824374_s_at | AATGATGGTGCTAAAATTCTTCCTATAAAATTCCTTAAAAATAAAGATGGTTTAATCACT ACCATTGTGAAAACATAACTGTTAGACTTCCCGTTTCTGAAAGAAAGAGCATCGTTCCAA TGCTTGTTCACTGTTCCTCTGTCATACTGTATCTGGAATGCTTTGTAATACTTGCATGCT TCTTAGACCAGAACATGTAGGTCCCCTTGTGTCTC | SEQ ID NO: 1002 |
| CD59 | ADXCRAD_BP396775_s_at | CCTCGTGGGTTTATTATTACCTCATAGGGACTTTGCCTCCTGACAGCAGTTTATGGGTGT TCATTGTGGCACTTGAGTTTTCTTGCATGCTTGTTAGAGAAACCAAGTTTGTCATCAACT TCTTATTTAACCCCCTGGCTATAACTTCATGGATTATGTTATAATTAAGCCATCCAGAGT AAAATCTGTTTAGATTATCTTGGAGTAAGGGGGAAAAAATCTGTAATTTTTTCTCCTCAA CTAG | SEQ ID NO: 1004 |
| PPIC | ADXCRAG_NM_000943_s_at | CCCTTCCTCAAGTGGTGCTATTTTAAAACTAAAAAAAACTTTGAATTGGCTATTTTTTTA ATGCAATATTTTTTTCTGAATTCATTATGATCCCCATATTGGGTAATGCTGAACATTTA TCTGAAACAGATGAGGATATTATTATTTTGTATCCAAACAGAAATTCAGATAAGGGAAA TTTGACTAGTGTAATCTGAGATATGTCATAGGGATTTCTTTCTGACAAAAGGGTGCTTTG CTGTTCTT | SEQ ID NO: 1006 |
| GRB10 | ADXCRAG_NM_001001549_s_at | AAGCTGGCGGTAGATTTGTGATGTCACAGTGCAAACTGCAGTGACTGTAAATTGGCCTGG CGTGTATAAACGTTTTCAGGGAATGCAGAAGGTATTAATGAAGAGACAAAACCTTTATTC CATGTGCTTTGCTTCATTCGTACATAGCTCTTTGGCTCGTGAACCTAATTGTAAACTTT CAGGTATTTTTGTACAAATAAGGGACTGATGTTCTGTTTCTTGTAATT | SEQ ID NO: 1007 |
| CAV2 | ADXCRAG_NM_001233_s_at | ATAAAACTGTTTGACTTCTCAAGTAACATGACTTCCTTATTCTGAACAGTACTGGTTAC TTTCAAAATGAATTTTTATTGAGATTTCCATTAACTATTTTTTTCAAAGACTCAAATTT TGTACCAAGTAAATCCAGGCTTTATGTACAAACATGTTGTTTTATTTGGGGCTGGG GGAGGTATATGATGAGCAGACTTCTCGGAATTCATAATAA | SEQ ID NO: 1009 |
| BCL6 | ADXCRAG_NM_001706_s_at | TTTTCAGTTTGTATATACCCGTACAACGTGTCCTCACGGTGCCTTTTTTCACGGAAGTTT TCAATGATGGGCGAGCGTGCACCATCCCTTTTTGAAGTGTAGGCAGACACAGGGACTTGA AGTTGTTACTAACTAAACTCTCTTTGGGAATGTTTGTCTCATCCCATTCTGCGTCATGCT TGTGTTATAACTACTCCGGAGACAGGGTTTGGCTGTGTCTAAACTGCATTACCGCGTTGT AAA | SEQ ID NO: 1011 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| LOX | ADXCRAD_CV574618_s_at | TAGAAGGCAAAGCAAAACTCCCAATGGATAAATCAGTGCCTGGTGTTCTGAAGTGGGAAA AAATAGACTAACTTCAGTAGGATTTATGTATTTTGAAAAAGAGAACAGAAAACAACAAAA GAATTTTTGTTTGGACTGTTTTCAATAACAAAGCACATAACTGGATTTTGAACGCTTAAG TCATCATTACTTGGGAAATTTTTAATGTTTATTATTTACATCACTTTGTGAATTAACACA GTGTTTCAATTCTGTAATTACATATTTGACTCTT | SEQ ID NO: 1013 |
| LOXL2 | ADXCRAG_NM_002318_s_at | CACCCCTTGTTTTTCAAGATACTATTATTATATTTTCACAGACTTTTGAAGCACAAATTT ATTGGCATTTAATATTGGACATCTGGGCCCTTGGAAGTACAAATCTAAGGAAAAACCAAC CCACTGTGTAAGTGACTCATCTTCCTGTTGTTCCAATTCTGTGGGTTTTTGATTCAACGG TGCTATAACCAGGGTCCTGG | SEQ ID NO: 1014 |
| NT5E | ADXCRAG_NM_002526_at | CTTTGAACCACTTTGCAATTGTAGATTCCCAACAATAAAATTGAAGA | SEQ ID NO: 1015 |
| NT5E | ADXCRAG_NM_002526_s_at | GCAGCAAAATAATAGCCTCGGTTCTATGCATATATGGATTGCTATAAAAAATGTCAATAA GATTGTACAAGGAAAATTAGAGAAAGTCACATTTAGGGTTTATTTTTTACACTTGGCCAG TAAAATAGGGTAAATCCTATTAGAAATTTTTTAAAGAACTTTTTTTAAGTTTCCTAAATC TGTGTGTGTATTGTGAAGTGGTATAAGAAATGACTTTGAACCACT | SEQ ID NO: 1016 |
| MAPK1 | ADXCRAG_NM_002745_s_at | TTCTGTGCAGAGATGACTGTCCAAGTGCCACATGCCTACGATTGAAATGAAAACTCTATT GTTACCTCTGAGTTGTGTTCCACGGAAAATGCTATCCAGCAGATCATTTAGGAAAAATAA TTCTATTTTTAGCTTTTCATTTCTCAGCTGTCCTTTTTCTTGTTTGATTTTTGACAGCA ATGGAGAATGGGTTATATAAAGACTGCCTGCTAATATGAACAGAAA | SEQ ID NO: 1017 |
| PSMD2 | ADXCRAD_CF130280_s_at | ACAGGGTTCCAGACGCATACAACCCCAGTGTTGTTGGCCCACGGGGAACGGGCAGAATTG GCCACTGAGGAGTTTCTTCCTGTTACCCCCATTCTGGAAGGTTTTGTTATCCTTCGGAAG AACCCCAATTATGATCTCTAAGTGACCACCAGGGGCTCTGAACTGTAGCTGATGTTATCA GCAGGCCATGCATCCTGCTGCCAAGGGTGGACACGGCTGCAGACTTCTGGGGGAATTGTC GCCTCCTGCTCTTTTGTTACTGAGTGAGA | SEQ ID NO: 1018 |
| VEGFA | ADXCRAG_NM_003376_at | ACGAAAGCGCAAGAAATCCCGGTATAAGTCCTGGAGCGTTCCCTGTGGGCCTT | SEQ ID NO: 1022 |
| VEGFA | ADXCRAD_AF091352_s_at | GCTGCTGCAATGACGAGGGCCTGGAGTGTGTGCCCACTGAGGAGTCCAACATCACCATGC AGATTATGCGGATCAAACCTCACCAAGGCCAGCACATAGGAGAGATGAGCTTCCTACAGC ACAACAAATGT | SEQ ID NO: 1023 |
| PPAP2B | ADXCRAD_CD678016_s_at | TAAACTGTGTCTCGACCTGTGTTATTTACATTAGCTGCTTAAAAAAGCATTGAGTTAATT TTTTTAAATATCAACTAAAATATCATAGTTCTGTGGTAGACATTGTTTTATAATGAAATA ACTGCAACTAGAGAAAACTGTATAAAAACATTAAATTGTCAGTATTTTTGTAAGGTTCCA TTTTGTAAAGAGAATAATATTCAAAGACTTTTGTAGCATACAAAGTGAAAACTTGTATCT GCGAAACTATACTTGTATTAAATGTGCTTTT | SEQ ID NO: 1024 |
| EGFR | ADXCRAD_BX378635_s_at | TCCTAATCTGTGTGTGCCCTGTAACCTGACTGGTTAACAGCAGTCCTTTGTAAACAGTGT TTTAAACTCTCCTAGTCAATATCCACCCCATCCAATTTATCAAGGAAGAAATGGTTCAGA AAATATTTTCAGCCTACAGTTATGTTCAGTCACACACACATACAAAATGTTCCTTTTGCT TTTAAAGTAATTTTTGACTCCCAGATCAGTCAGAGCCCCTACAGCATTGTTAA | SEQ ID NO: 1026 |
| GATA6 | ADXCRAG_NM_005257_at | ATGCTGTATGTGACTATAGATATTCATATAAAACAAGTGCACGTGAAGTTTGCAAAATGC TTTAAGGCCTTCCTTTCAAAGCATAGTCCTTTTGGAGCCGTTTTGTACCTTTTATACCTT GGCTTATTTGAAGTTGACACATGGGGTTAGTTACTACTCTCCATGTGCATTGGG | SEQ ID NO: 1027 |
| FOSL1 | ADXCRAG_NM_005438_s_at | GTGCCACTTTACCCACCTAGAACACTAACTCACCAGCCCCACTGCCAGCAGCAGCAGGTG ATTGGACCAGGCCATTCTGCCGCCCCCTCCTGAACCGCACAGCTCAGGAGGCGCCCTTGG CTTCTGTGATGAGCTGATCTGCGGATCTCAGCTTTGAGAAGCCTTCAGCTCCAGGGAATC CAAGCCTCCACAGCGAGGGCAGCTGCTATTTATTTTCCTAAAGAGAGTATTTTTATACAA ACCTACCAAAATGGAATAAAAGGCTTGAAGCT | SEQ ID NO: 1028 |
| LPP | ADXCRAG_NM_005578_at | AAATAAGTCATGTGTCCCAGCATAAGGCATCAGGTTGTTAGATGCTGGCATCTCTGCAGC TCAAAGATGTGGGTTCTTTTTCTTGTCATTAACACATTGTTATTTCTGTAGGACCAACTT CTCTGATCAAAATTACTTTTCTGGGTATGTGCTGATTAAGGGGGTGGACTTATCAACACT ATAATTGTTCCCTATGAAAGATTCCACAGAGATGTTTATGGTGA | SEQ ID NO: 1031 |
| BASP1 | ADXCRAD_CN355199_s_at | GCGTTTGATTCTGCCCACAGGGCCTGTGCCAAGGCAATCAGATCTTTATGAGAGCAGTAT TTTCTGTGTTTTCTTTTTAATTTACAGCCTTTCTTATTTTGATATTTTTTAATGTTGTG GATGAATGCCAGCTTTCAGACAGAGCCCACTTAGCCTTGTCCACATGGATCTCAATGCCAA TCCTCCATTCTTCCTCTCCAGATATTTTTGGGAGTGACAAACATTCTCTCATCCTACTTA GCCTACCTAGATTTCTCATGACGAGTTAATGCATGTCCGTGGTTGGGTGCACCTGTA | SEQ ID NO: 1034 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| CORO1C | ADXCRAG_NM_014325_s_at | GCAAGGGAAAGTTACCCTGATCTTAGTTTGTAGCTTATGACTTATTTAATGAATGGATGC CCAGCCAAGCTCAGAGTAGGCGCCCAAAGCATTGTGGATTATTTTCCTGTTTTGTCTTTT TTTTTTTTTTTTTTAAGCCATGACATCCCAGAAGAGGACAGTGAATTACTCCTAGGTCG GCTCTTATAGAGTGGCCATAGTGTTCTGTCAAAA | SEQ ID NO: 1041 |
| EHD2 | ADXCRAD_BX369705_s_at | CTCCTTTTCAGGGATGTCGTGGGCGGGGGAGGGGGTTCTTGGTGCTACAGCCCTCTCCCC ACCCCTAAAGGGACGCCGACGCTGTTTGCTGCCTTCACCACATATTAGTGCTTGACCCTG GCAGGGGACCCCATGGAAAAGATGGGGAAGAGCAAAATACATGGAGACGACGCACCCTCC AGGATGCTCGCTGGGATTCCCACGCCCACCACTGTCCCCCACCCCATGGCTGGGAGGGGC CTCTGAACGGAACAGTGTCCCCACAGAGCGAATAAAGCCAAGGCTTCTTCCCA | SEQ ID NO: 1043 |
| HK1 | ADXCRAG_NM_033497_s_at | GTGGGCATAGCATTAGCTGCTTCCTCCCCTCCTGGCACCCACTGTGGCCTGGCATCGCAT CGTGGTGTGTCAATGCCACAAAATCGTGTGTCCGTGGAACCAGTCCTAGCCGCGTGTGAC AGTCTTGCATTCTGTTTGTCTCGTGGGGGAGGTGGACAGTCCTGCGGAAATGTGTCTTG TCTTCCATTTGGATAAAAGGAACCAACCAACAAACAATGCCATCACTGGAATTTCCCACC GCTTTGTGAGCCGTGTCGTATGACCTAGTAAACTTTGTACCA | SEQ ID NO: 1049 |
| COL6A2 | ADXCRAG_NM_058175_s_at | TGGTGGCCACCGTGTCCCTTGCTGCGGCTGCATCTTCCAGTCTCTCCTCCGTCTTCCAGT GGCCGCTCTCTTTATAAGAACCCTGGTCATTGAATTTAAGGCCCACCCCAAGTCCAGAAT GACCTCGCAAGACCC | SEQ ID NO: 1050 |
| MALT1 | ADXCRAG_NM_173844_s_at | ACATTATACTTCATGGTGATAGACTGAAGGCTGAATGTTTTCCCCTTAAGATTGGGAAGA AGGACAAGGATGTTCACTCGGCACTACTTCTATTCAGCATTGTACTTGAAGTTCTAGCCA CAGCAGTTAGGTTAGGAATTCAAGGTTTGTTCAACA | SEQ ID NO: 1053 |
| IL6ST | ADXCRAD_CN265168_s_at | AACAGTTGGCATGGAGGCTGCGACTGATGAAGGCATGCCTAAAAGTTACTTACCACAGAC TGTACGGCAAGGCGGCTACATGCCTCAGTGAAGGACTAGTAGTTCCTGCTACAACTTCAG CAGTACCTATAAAGTAAAGCTAAATGATTTTATCTGTGAATTCAGATTTTAAAAAGTCT TCACTCTCTGAAGATGATCATTTTGCCCTTAAGGACAAAAATGAACTGAAGTTTCACATGA GCTATTTCCATTCCAGAATATCTGGGATTCTACTTTAAGCACTA | SEQ ID NO: 1054 |
| PLOD2 | ADXCRAD_BF971357_s_at | AACAAAGTTGTTGAGCCTTGCTTCTTCCGTTTTGCCCTTTGTCTCGCTCCTTATTCTTTT TATGGGGGAGGGTTATTTGCTTTTTTATCTTCCTGGCATAATTTCCATTTTATTCTTCT GAGTGTCTATGTTAACTTCCCTCTATCCCGCTTATAAAAAAATTCTCCAACAAAAATACT TGTTGACTTGATGTTTTATCACTTCTCTAAGTAAGGTTGA | SEQ ID NO: 1056 |
| EXT1 | ADXCRAG_579639_s_at | CGACTTTGAGGAATCCGGCTGAGTGGGGGAGGGGAAGCAAGAAGGGATGGGGGTCAAGCT GCTCTCTCTTCCCAGTGCAGATCCACTCATCAGCAGAGCCAGATTGTGCCAACTATCAA AAACTTAGATGAGCAGAATGACAAAAAAAAAAAAGGCCAATGAGAACTCAACTCCTGGCT CCTGGGACTGCACCAGACTGCTCCAAACTCACCTCACTGGCTTCTGTGTCCCAAGACTAG GTTG | SEQ ID NO: 1058 |
| CYP1B1 | ADXCRAD_AV717387_s_at | TTTGTGTGTTTTTAGCTGTGACACAACTGTGTGATTAAAAGGTATACTTTAGTAGACATT TATAACTCAAGGATACCTTCTTATTTAATCTTTTCTTATTTTTGTACTTTATCATGAATG CTTTTAGTGTGTGCATAATAGCTACAGTGCATAGTTGTAGACAAAGTACATTCTGGGGAA ACAACATTTATATGTAGCCTTTACTGTTTGATA | SEQ ID NO: 1060 |
| VCAN | ADXCRAD_CN312093_s_at | GGAGCCTTAGAGGTCTTTAATCATTGGTTCGGCTGCTTTTATGTAGTTTAGGCTGGAAAT GGTTTCACTTGCTCTTTGACTGTCAGCAAGACTGAAGATGGCTTTTCCTGGACAGCTAGA AAACACAAAATCTTGTAGGTCATTGCACCTATCTCAGCCATAGGTGCAGTTTGCTTCTAC ATGATGCTAAAGGCTGCGAATGGGATCCTGATGGAACTAAGGACTCCAATGTCGAACTCT TCTT | SEQ ID NO: 1063 |
| FOXN3 | ADXCRAG_U68723_at | TTTTTCTGTCTATCAAAACTATTTGATCCAAGTGAAAAAAAAAAAAAAACTAGAAAGCTA CGGAACCTGCAATGCGGCCG | SEQ ID NO: 1072 |
| FOXN3 | ADXCRAD_CR735795_s_at | TGGACGTTGGACTGTTCATGCGCATCGGGTGTCAGTGACTCATGGAGAAGAAATGGGGTA AATTTTTAGTGATGTTGCTAATCATTGAATTCTGTTCTCTATTAAATTAAGAAAATGTTC CAAAAGCCATAAGCCTGAAGATTGGCCCTGTGCACGCACGCACACACACACACACACACA CACACACACACACACGCAAGGAGAGAGAGAGAGAAACTGATGGGGAAAACAAGCTGTG TCTTCTTAACTGCCCAAGTGAAAAGCAACCAAGTCCAGGAAATTACAATAGCTGTT | SEQ ID NO: 1073 |
| NFIB | ADXCRAG_U85193_at | GGGAATTCATGGATTATTAAGGTCCTTCAGGCCCTTG | SEQ ID NO: 1076 |
| NR3C1 | ADXCRAG_X03348_s_at | AAAGTGTCTTTTTACCTACGCAGTGAAATGTCAGACTGTAAAACCTTGTGTGGAAATGTT TAACTTTTATTTTTTCATTTAAATTTGCTGTTCTGGTATTACCAAACCACACATTTGTAC CGAATTGGCAGTAAATGTTAGCCATTTACAGCAATGCCAAATATGGAG | SEQ ID NO: 1078 |
| COL4A2 | ADXCRAG_X05562_at | CAAAGGCGAGGCTGGATTTTTCGGAATACCCGGTCTGAAGGGTCTGGCTGGTGAGCCAGG TTTAAAGGCAGCCGAGGGGACCCTGGGCCCCAGGACCACCTTCCTGTCATCCTGCCAGG AATGAAAGACATTAAAGGAGAGAAAGGAGATGAAGGGCCTATGGGGCTGAAAGGATACCT | SEQ ID NO: 1079 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | GGGCGCAAAAGGTATCCAAGGAATGCCAGGCATCCCAGGGCTGTCAGGAATCCCTGGGCT GCCTGGGAGGCCCGGCCACATCAAAGGAGTCAAGGGAGACATCGGAGTCCCT | |
| ZNF264 | ADXCRAD_BP361385_s_at | TCCATTGGGTGGGTTCTTTTGTACACCTTCTGTTTCTTTGCTTATTTTTAACGCCAAAG AAAGACTCTCAGAGAATAGACAACTATATTCCAAAGTCATGGTTCTCTGGTGGTTTGTCT TGACATTTGAATAGAAATGTTAAACTATCTGGGGGAATAGAAAGCCCACAGTCTTCTGAG TTGTGCTACACCAATATTTCTATGAACAGATCTTACAACTGAGAGTGATCTGCAGATTTT TCAGAGTCATGTTCTCCATGGAAATGTTTGTAAAATTCCCTAGCTCTCTG | SEQ ID NO: 1091 |
| MAP1B | ADXCRAD_AV721962_s_at | TCCAGCACTGGAAAGAAGTGGTCTTGAGCCCAGCTGAGAAGCACTTCACACTCCTCTCTC TTGTTCTGAATGGTGTTTGTGTCAGTCTGCAGCTGTGTATGGTATTATGTCTTA | SEQ ID NO: 1094 |
| ALCAM | ADXCRAD_CB160126_s_at | ATTACCATCGATTCAGTGCCTGGATAAAGAGGAAAGCTTACTTGTTTAATGGCAGCCACA TGCACGAAGATGCTAAGAAGAAAAAGAATTCCAAATCCTCAACTTTTGAGGTTTCGGCTC TCCAATTTAACTCTTTGGCAACAGGAAACAGGTTTTGCAAGTTCAAGGTTCACTCCCTAT ATGTGATTATAGGAATTGTTTGTGGAAATGGATTAACATACCCGTCTATGCCTAAAAGAT AA | SEQ ID NO: 1095 |
| PYGL | ADXCRAG_Y15233_s_at | GTCTTTGCAGACTACGAAGCCTATGTCAAGTGTCAAGATAAAGTGAGTCAGCTGTACATG AATCCAAAGGCCTGGAACACAATGGTACTCAAAACATAGCTGCCTCGGGGAAATTCTCC AGTGACCGAACAATTAAAGAATATGCCCAAAACATCTGGAACGTGGAACCTTCAGATCTA AAGATTTCTCTATCCAATGAATCTAAC | SEQ ID NO: 1096 |
| PTPRK | ADXCRAG_Z70660_at | TATTGAGCCAGCAGCTGTTGTACCTGTTACACTTGTGCAGAAAGATTTTAATGTGGGGGG TGGGAGACTTTTACATTTGAGAGGTAAAAGTATTTTTTTTATGAAGTTGTGTATCTTAAT AAAAAGAACTGAATTAGTTTTTATTACTATATTAAAGCATCAACATTTCATGCCACATAA AATTATATTTAATAAGAACCAGATTGAAATGAGAACGTATTGGTGTTTGTACAGTGAACA TGCCACCTTTTTCCATGGTTTCAGGTAGTGCAGCTACCACATGTT | SEQ ID NO: 1097 |
| LMNA | ADXCRIH.3276.C1_s_at | CCCAGAACTGCAGCATCATGTAATCTGGGACCTGCCAGGCAGGGGTGGGGGTGGAGGCTT CCTGCGTCCTCCTCACCTCATGCCCACCCCCTGCCCTGCACGTCATGGGAGG | SEQ ID NO: 1099 |
| CKAP4 | ADXCRIH.293.C1_s_at | CTTGTCCCCTCTTAAAGAGCAGTTGTCACCACCTGAACACCAAGGCATTGTATTTTCATG CCCAGTTAACTTATTTCAATATTTAAGTTCTCTGCTTCTGCATTTGGTTGGTTTCCTGA AGCGCAGCCCCTGTGAATAACAGGTGGCTTTTCATGGATGTCTCTAGTCAGAG | SEQ ID NO: 1103 |
| CD44 | ADXCRAD_CN347079_s_at | TCAACAGTCGAAGAGGTGTGGGCAGAAGAAAAAGCTAGTGATCAACAGTGGCAATGGAG CTGTGGAGGACAGAAAGCCAAGTGGACTCAACGGAGAGGCCAGCAAGTCTCAGGAAATGG TGCATTTGGTGAACAAGGAGTCGTCAGAAACTCCAGACCAGTTTATGACAGCTGATGAGA CAAGGAACCTGCAGA | SEQ ID NO: 1104 |
| AHNAK | ADXCRIH.2649.C1_s_at | GTGGTCCCAGCCAGTTTGGTGCTGACGGTGAGAGGAAATTAGAATCTGTTTGCAAATTGT CCAACCCACCCCCTCAACATGAGGGGCTTCCATTTTCTGTGTTTTGTAAGGGAACTGTTT CCTTCATGCCGCCATGTTCCTGATATTAGTTCTGATTTCTTTTTAACAAATGTTATCATG ATTAAGAAAATTTCCAGCACTTTAATGGCCAATTAACT | SEQ ID NO: 1106 |
| RYBP | ADXCRIH.2682.C1_at | ACATCCCTCAGGCATGTATTCTGGAAATGGAATTCCTGTAACTTCCTGTGTCTGCAGTAT GCCCTACAATTAGTAGGCAGCGTGTAAAAACACTAGTGATTATAAAGATATACATTA AAAGAGGACCAGAAATACTTGGTATTCAGTGGCACAGAAAGCAGGTTAAACAAACAAAAA GCACAGTGTTACGCTTGCAAGTTTCCATTTGTTTTAATACCACGCAATCTTTCACACTCG TGCGTGTGCGCGCACACAGAGCTTACCTGACTTGCTCTGCTTGAGTCATGCAG | SEQ ID NO: 1109 |
| MARCKS | ADXCRIH.653.C1_s_at | AGTGAATAGTCAAAAATCCTGTTAGCAAACTGTTATATATTGCTAAGTTTGTTCTTTTAA CAGCTGGAATTTATTAAGATGCATTATTTTGATTTTATTCACTGCCTAAAACACTTTGGG TGGTATTGATGGAGTTGGTGGATTTTCCTCCAAGTGATTAAATGA | SEQ ID NO: 1112 |
| RRAS2 | ADXCRIH.3655.C1_at | TTCTTTGTCAGTTAAAAGTGAACAGTGAGAATTAAATACTTATCTTTACATATACACAAG GTATGCTATGAAAGCATATCTGCTTACAAACATATAAAAATACTTGTTAACTAGTTTGAT AAGAAAATAATGTATAAAAGTATATAGCAAAAACATTAATCATCTCTGACCCTGGAAAGA TCAATTCCATATTTTATAT | SEQ ID NO: 1113 |
| TGFBR2 | ADXCRIH.688.C1_s_at | AGTCCACGTTCACAAAATGTGAAGGTGTGGAGACACTTACAAAGCTGCCTCACTTCTCAC TGTAAACATTAGCTCTTTCCACTGCCTACCTGGACCCCAGTCTAGGAATTAAATCTGCAC CTAACCAAGGTCCCTTGTAAGAAATGTCCATTCA | SEQ ID NO: 1115 |
| SDC4 | ADXCRIH.1351.C1_s_at | GATGGTGGGATATTTGTGTCTGTGTTCTTATAATATATTATTATTCTTCCTTGGTTCTAG AAAAATAGATAAATATATTTTTTCAGGAAATAGTGTGGTGTTTCCAGTTTGATGTTGCT GGGTGGTTGAGTGAGTGAATTTTCATGTGGCTGGGTGGGTT | SEQ ID NO: 1116 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| EPHA2 | ADXCRIH.2345.C1_s_at | TGGCCCAGCGCCAAGTAAACAGGGTACCTCAAGCCCCATTTCCTCACACTAAGAGGGCAG ACTGTGAACTTGACTGGGTGAGACCCAAAGCGGTCCCTGTCCCTCTAGTGCCTTCTTTAG ACCCTCGGGCCCCATCCTCATCCCTGACTGGCCAAACCCTTGCTTTCCTGGGCCTTTGCA AGATGCTTGGTTGTGTTGAGGTTTT | SEQ ID NO: 1120 |
| S100A11 | ADXCRIH.305.C1_s_at | AACTGGACACCAACAGTGATGGTCAGCTAGATTTCTCAGAATTTCTTAATCTGATTGGTG GCCTAGCTATGGCTTGCCATGACTCCTTCCTCAAGGCTGTCCCTTCCCAGAAGCGGACCT GAGGACCCCTTGGCCCTGGCCTTCAAACCCACCCCCTTTCCTTCCAGCCTTTCTGTCATC ATCTCCACAGCCCACCCATCCCTGAGCACACTAACCACCTCATGCAGG | SEQ ID NO: 1121 |
| FLNB | ADXCRIH.1727.C1_s_at | GGGCCCATGGATTAACGCCCTCATCCCAAGGTCCGTCCCATGACATAACACTCCACACCC GCCCCAGCCAACTTCATGGGTCACTTTTTCTGGAAAATAATGATCTGTACAGACAGGACA GAATGAAACTCCTGCGGCTCTTTGGCCTGAAAGTTGGGAATGGTTGGGAGAGAAGGCAG CAGCTTATTGGTGGTCTTTTCACCATTGGCAGAAACAG | SEQ ID NO: 1127 |
| CRIM1 | ADXCRAD_BG621095_s_at | AAAAAATTGTAGATGCTTGCTTTTTGTTTTTTCAATCATGGCCATATTATGAAAATACTA ACAGGATATAGGACAAGGTGTAAATTTTTTTATTATTATTTTAACAGATATGATTTATCC TGAGTGCTGTATCTATTACTCTTTTACTTTGGTTCCTGTTGTGCTCTTGTAAAAAGAAAA ATATAAATTTCCTGAAGAATAAAATAGATATATGGCACTTGGAGTGCATCATAGTTCTAC AGTTTGTTT | SEQ ID NO: 1128 |
| IGFBP3 | ADXCRIH.1767.C1_s_at | GATGCTATATGATACAACTGTGGCCATGACTGAGGAAAGGAGCTCACGCCCAGAGACTGG GCTGCTCTCCCGGAGGCCAAACCCAAGAAGGTCTGGCAAAGTCAGGCTCAGGGAGACTCT GCCCTGCTGCAGACCTCGGTGTGGACACACGCTGCATAGAGCTCTCCTTGAAAACAGAGG GGTCTCAAGACATTCTGCCTACCTATTAGCNNNNNNNNNNNNNNNNNNNNNNNNNNGGGGGG AAAAGTATTTTTGAGAAGTTTGTCTTGCAATGTATTT | SEQ ID NO: 1130 |
| PDLIM7 | ADXCRIH.3383.C1_s_at | ATGCACCCAGCTGTGCCAAGTCAAGAAGAAGATTACAGGCGAGATCATGCACGCCCTGA AGATGACCTGGCACGTGCACTGCTTTACCTGTGCTGCCTGCAAGACGCCCATCCGGAACA GGGCCTTCTACATGGAGGAGGGCGTGCCCTATTGCGAGCGAGACTATGAGAAGATGTTTG GCACGAAATGCCATGGCTGTGACTTCAAGATCGACGCTGGGGACCGCTTCCTGGAGGCCC TGGGCTTCAGCTGGCATGACACCTG | SEQ ID NO: 1132 |
| WDR1 | ADXCRIH.1007.C1_at | CTTTTCTTTTTCAGTGCAGAAATAAAAGTAAATAATAAGCACGGTGATTGGGA | SEQ ID NO: 1135 |
| WDR1 | ADXCRAD_BU073170_s_at | CATTGTCAGATTTTGTGCTTGATTTTAAGAATGGAATTGTGGGTATCTTTCCTTTTTTTT TAATGTATCTTAACTGTTGCCTGTCAGTGTTTACAAACTAGTGCGTTGACGGCACCGTGT CCAAGTTTTTAGAACCCTTGTTAGCCAGACCGAGGTGTCCTGGTCACCGTTTCACCATCA TGCTTT | SEQ ID NO: 1136 |
| IL8 | ADXCRIH.2782.C1_at | CTGTGTTGGCGCAGTGTGGTCCACTCTCAATCACTCTCAGTTCTTTGATAAATTTGGGGT GGAAAGGTTTGGAGTATGTCTTTATGCACTGACATCTAAGTTCTTTAGCACTCCTTGGCA AAACTGCACCTTCACACAGAGCTGCAGAAATCAGGAAGGCTGCCAAGAGAGCCACGGCCA GCTTGGAAGTCATGTTTACACACAGTGAGATGGTTCCTTCCGGTGGTTTCTTCCTGGCTC TTGTCCTAGAAGCTTGTGTGCTCCTCG | SEQ ID NO: 1141 |
| VEGFA | ADXCRIH.2785.C1_s_at | GAACACCGACAAACCCAGCCCTGGCGCTGAGCCTCTCTACCCCAGGTCAGACGGACAGAA AGACAGATCACAGGTACAGGGATGAGGACACCGGCTCTGACCAGGAGTTTGGGGAGCTTC AGGACATTGC | SEQ ID NO: 1142 |
| TNFRSF12A | ADXCRIH.3000.C1_at | CAAAATAAATATCTCCTCCCCGCTTTGGGGAGTTGGGGGGGTCTGTATCTTAGGGCCAGC CCTCCTAGTGGGCCAGCCCCCTAGTGTTAAAAATAGGTCCCTAACCCCCCAGGGTGACCC CCGTGGTGGAATTTCAGGACATCTGAGTGAGTGGGGCCTAGTGTCAAGTCTGCCCCCCAA GTCAGCCTGGCCCCCAGGGCCTCTAGGAAGGCCTCGTGC | SEQ ID NO: 1150 |
| LAPTM4B | ADXCRIH.1454.C1_s_at | TATATTTGATATACTTCTGCCTAACAACATGGAAAAGGGTTTTCTTTTCCCTGCAAGCTA CATCCTACTGCTTTGAACTTCCAAGTATGTCTAGTCACCTTTTAAAATGTAAACATTTTC AGAAAAATGAGGATTGCCTTCCTTGT | SEQ ID NO: 1153 |
| PEA15 | ADXCRAD_CX867144_s_at | GTGTTTTCCTTTGCACCGATCCCCACCCCAATTCAATCCCGGAAGGGACTTACTTAGGAA ACCCTTCTTTACTAGATATCCTGGCCCCCTGGGCTTGTGAACACCTCCTAGCCACATCAC TACAGTACAGTGAGTGACCCCAGCCTCCTGCCTACCCCAAGATGCCCCTCCCCACCCTGA CCGTGCTAACTGTGTGTACATATATATTCTACATATATGTATATTAAAACTGCACTGCCA TGTCTGCCCTTT | SEQ ID NO: 1154 |
| JAK1 | ADXCRIH.1478.C1_s_at | TTTTCAGTTTGCTTGGAGGTAGCTGGGTAATCAAAAATGTTTAGTCATTGATTCAATGTG AACGATTACGGTCTTTATGACCAAGAGTCTTAAATCTTTTTGTTATGCTGTTTAGTATT CGTTTGATATTGTTACTTTTCACCTGTTGAGCCCAAATTCAGGATTGGTTCAGTGGCAGC AATGAAGTTGCCATTTAAATTTGTTCATAGCCTACATCACCAAGGTCTCTGTGTCAAACC TGTGGCCACTCTATATGCACTTTGTTTA | SEQ ID NO: 1156 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| CNN3 | ADXCRIH.2427.C1_s_at | GCATTTGTGATTATATGTGTACTCATTCTCTTACCTAGCGAACAAGATCTTTTCAAAGTG GTGTTTCTAAAAGAGCATGTACAAAAGTGGCCTGTGGACATTTAGGCCTGGGTGATGCAT TTGCTCTTCCTGTTTGTGCCAATGTATCAATGTAAAGTTGCTCTGTTTTCTTCAACTGTA TTTATTGCTGCATTTCTCAGCATAAACTTATCCCATTGT | SEQ ID NO: 1157 |
| VIM | ADXCRIH.436.C1_at | TATTCTGAATCTCATCCTGCAGGCGGCCAATAGTGTCTTGGTAGTTAGCAGCTTCAACGG CAAAGTTCTCTTCCATTTCACGCATCTGGCGTTCCAGGGACTCATTGGTTCCTTTAAGGG CATCCACTTCACAGGTGAGGGACTGCACCTGTCTCCGGTACTCAGTGGACTCCTGCTTTG CCTGGCGCAGGGCGTCATTGTTCCGGTTGGCAGCCTCAGAGAGTCAGCAAACTTGGATTT CCTCTTCGTGGAGTTTCTTCAAAAGGCAATCTCTTCTTGCAAAGAT | SEQ ID NO: 1159 |
| COL4A1 | ADXCRIH.2482.C1_s_at | ATAAAGCTTACATAGTTTTCTTCCTTTGAAAGACTGTGCTGTCCTTTAACATAGGTTTTT AAAGACTAGGATATTGAATGTGAAACATCCGTTTTCATTGTTCACTTCTAAACCAAAAAT TATGTGTTGCCAAAACCAAACCCAGGTTCATGAATATGGTGTCTATTATAGTGAAACATG TACTTTGAGCTTATTGTTTTTATTCTGTATTAAATATTTTCAGGGTTTTAAACACTAATC ACAAACTGAATGACTTGACTTCAAAAGCAACAACCTTAAA | SEQ ID NO: 1160 |
| NPC2 | ADXCRIH.1839.C1_s_at | AGTCTGCTGAGACTCTTGACAGCACCTCCAGCTCTGCTGCTTCAACAACAGTGACTTGCT CTCCAATGGTATCCAGTGATTCGTTGAAGAGGAGGTGCTCTGTAGCAGAAACTGAGCTCC GGGTGGCTGGTTCTCAGTGGTTGTCTCATGTCTCTTTTTCTGTCTTAGGTGGTTTCATTA AATGCAGCACTTGGT | SEQ ID NO: 1163 |
| OPTN | ADXCRIH.2853.C1_at | GACCAGCTCAGGACCCAGGTGGTGAGGCTACAAGCAGAGAAGGCAGACCTGTTGGGCATC GTGTCTGAACTGCAGCTCAAGCTGAACTCCAGCGGCTCCTCAGAAGATTCCTTTGTTGAA ATTAGGATGGCTGAAGGAGAAGCAGAAGGGTCAGTAAAAGAAATCAAGCATAGTCCTGGG GCCCACGAGAACAGTCTCCACTGGCACGGCATTGTCTAAATATAGGAGCAGATCTGCAGA TGGGGCCCAGAATTACTTCGAACATGAGGAGTTAACTG | SEQ ID NO: 1174 |
| PLAUR | ADXCRIH.1121.C1_at | GGTAAGGCTGGTGATCTTCAAGCCAGTCCGATAGCTCAGGGTCCTGTTGGTCTTCTCTGA GTGGGTACAGCTTTTCTCCACCAGCTCCAGCTCTTCTCCTTCTTCCCACAAGCGCACGAT CGTGGTCCTGCAGAGGTCCTGTCCCAGGGCGCACTCTTCCACACGGCAATCCCCGTTGGT CTTACACTGCATGCACCGCA | SEQ ID NO: 1175 |
| SVIL | ADXCRIH.3823.C1_at | GGCATTGCCTAGCTGGAACAAGAAGGCAGTGCTATCTATAGCAGCTGCGGCTTAAGTGCA CATAACAGATACTTTTATTAATTCTGATAACCTCCTGAATGGTGGAAAGAAGTTTCCAAA CAGTTCCCTTGAACATTTACAAAATACACAACTCCGGGACAGCAGTATCTTTAACAATGT CATGTTCTGAAAACTCTGAT | SEQ ID NO: 1176 |
| PRSS23 | ADXCRIH.833.C1_at | CCAGATTTGCTATTGGATTAAAGGAAACTACCTGGATTGTAGGGAGGGGTGACACAGTGT TCCCTCCTGGCAGCAATTAAGGGTCTTCATGTTCTTATTTTAGGAGAGGCCAAATTGTTT TTTGTCATTGGCGTGCACACNNNNNNNNNNNNNNNNNNNNNNNNNNNAAGGTGTCTTATAA TCTTTTACCTATTTCTTACAATTGCAAGATGACTGGCTTTACTATTTGAAAACTGGTTTG TGTATCATATCATATATCATTTTAGCAGTTTGAAGGCATACTTTTGCAT | SEQ ID NO: 1177 |
| C19orf10 | ADXCRIH.3832.C1_s_at | AGAGAACAGAGGGTCCAGGGCCCTCCTGGCTCCCAACAGCTTCTCAGTTCCCACTTCCTG CTGAGCTCTTCTGGACTCATGATCGCAGATCCGGGCACAAAGAGGGTGGGGAACATGGG GGCTATGCTGGGGAAAGCAGCCATGCTCCCCCGACCTCCAGCCGAGCATCCTTCATGAGC CTGCAGAACTGCTTTCCTATGTTTACCCAGGG | SEQ ID NO: 1178 |
| GATA6 | ADXCRIH.2898.C1_s_at | AAGTCACGTCCTCCGTGCGACCGGATTCCTGGTGCGCCCTGGCCCTGGCCTGAGCCCACG CCGCCAGGAGGCAGGGAGGGCTCCGCCGCGGGCCTCACTCCACTCGTGTCTCGTTTTGTG CAGCAGTCCAGACAGTGGCGACTGCGCTGACAGAACGTGATTCTCGTGCCTTTATTTTGA AAGAGATGTTTTTCCCAAGAGGCTTGCTGAAAGAGTGAGAGAAGATGGAAGGGAAGGGCC AGTGCAACTGGGCGCTTGGGCCACTCCA | SEQ ID NO: 1180 |
| LGALS1 | ADXCRIH.2899.C1_at | GAAAGACAGCCTCCCGCTGCTCGGTCCCCAGGCCCCGCCGTCCTTGCTGTTGCACACGA TGGTGTTGGCGTCGCCGTGGGCGTTGAAGCGAGGGTTGAAGTGCAGGCACAGGTTGTTGC TGTCTTTGCCCAGGTTCAGCACGAAGCTCTTAGCGTCAGGAGCCACCTCGCCTCGCACTC GAAGGCACTCTCCAGGTTTGAGATTCAGGTTGCTGGCGACCAGACCACAAGCCATGATT | SEQ ID NO: 1181 |
| PTPRK | ADXCRIH.91.C1_at | TATAATGTGCTTTCTCCATATAGACATATTTACACTTGAGTCTTTGGCTTATGTTATTTT CTAAAAGAACTTTAAATGATCCAGCCATCATTGCACATTAAAAGAAAATAAGCCAGTTA TATATATTTATATATTCCCATAGAGATCTGCTACACTGGAAACATATAAAAAACGAACTT TACTATGAATTTGCACAGCTTTTCTTTTCTTCCTTTTAAGATTCATCAGCTTTCATT TTAGAAAGGGAGCCTCGTGC | SEQ ID NO: 1182 |
| SLC39A7 | ADXCRIH.2110.C1_at | AGGGTTAGTTGGTATTCTCATGGCCTGATTTTTTTGTTTCTATTCCTTTTATATCACTG TGTTTGAATCGAGGGGGAGGGTGGTAACCGGAAATAAAGATCTCCGATCTTCCGCC | SEQ ID NO: 1185 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| SLC39A7 | ADXCRAD_BM796805_s_at | ATAGTGTTGGGCACTGTCTGACCATGTTGCATTTGGAAGGCTAAATGGGGCCATGAAGAA GGCTGGAAGGGACAGGTGGTGATGGCAGCCTACCTGGTGTCCCCTACCCCACCTGTTCTC GGAGAACCAAGTTGCTACACAGGAAGTTCTCCAAGGTCCAGTTTCCTTTCTCCCACCAGT TGGTGGAGGCTTCAGGGAAGACCAGAGTCCTGNACAGAGAGGGTAACAGGAGGAGTCGGG GATAAACATCAAACATCAATCGTGTGTCCTGATTTGGGAGTGAT | SEQ ID NO: 1186 |
| RRAS | ADXCRIH.3859.C1_at | GAGGCCTCAAAGTAGGCCACGTGGTGGGAGGCGCCGAAGGCAGAGGCTTCTGATCGGGGG ACCTGGCGCTGTGACTCCAGATCTGCCTTGTTCCCGACCAACACAACGGGGAAGTCGTCG CGGTCCTTGACCCGCAGAATCTGCGTGAAGAGCTTGCCCACCTCGTTGAAACTCTGCCGG TCATTAATGGCGAACACCAGCAGGAAACCGTGGCCAGCACGCATGTACTGCTCTCTCATG GCCCCGAACTCTTCCTGGCCCGCGGTGTCCAGGGATGTCCAGC | SEQ ID NO: 1188 |
| PLAU | ADXCRIH.107.C1_at | TCACTGGGTGGGGTGAGGACCACTCCTTACACTG | SEQ ID NO: 1192 |
| PLAU | ADXCRIH.107.C1_s_at | TAAGTGTGAGTAAGAGCTGGTGTCTGATTGTTAAGTCTAAATATTTCCTTAAACTGTGTG GACTGTGATGCCACACAGAGTGGTCTTTCTGGAGAGGTTATAGGTCACTCCTGGGGCCTC TTGGGTCCCCCACGTGACAGTGCCTGGGAATGTATTATTCTGCAGCATGACCTGTGACCA GCACTGTCTCAGTTTCACTTTCACATAGATGTCCCTTTCTTGGCCAGTTATCCCTTCCTT TTAGCCTAGTTCATCCAATCCTCACTGGGTGGG | SEQ ID NO: 1193 |
| MXRA7 | ADXCRIH.2503.C1_at | ATGGCAACAGCCACACAGTCATTGCCTTCAACACAGAGCCACGTGTCCCCAAACAGCAAT AGTCATGCCCTTGTCCAGGCTGGGATCTAATTGATACAATAGGTCGTTGACTCCCTCCTA GTAGAGCTATCTAGGTTTGTCTGGAAAGTTTCCGACCCTGGCTTATAGGCACCACACCTC ATGTACTCCTCATGGCTTGGATCTCTGTATTCAGCCTTTGTTCAGTCC | SEQ ID NO: 1205 |
| CYR61 | ADXCRIH.1579.C1_at | TACCTAATATCTGAGTGTATGCCATTCGGTATTTTTAGAGGTGCTCCAAAGTCATTAGGA ACAACCTAGCTCACGTACTCAATTATTCAAACAGGACTTATTGGGATACAGCAGTGAATT AAGCTATTAAATAAGATAATGATTGCTTTTATACCTTCAGTAGAGAAAAGTCTTTGCAT ATAAAGTAATGTTTAAAAAACATGTATTGAACACGACATTGTATGAAGCACAA | SEQ ID NO: 1207 |
| HSBP1 | ADXCRIH.524.C1_at | CCCTTCAATTATAGTTAGTCTTGGTGAAGTAAGATGTTTGTAGACTTTAGAGTTCTTTAA TTCTTGGCACAACGTGACTGTTGAGCTAACACCAAATAGTGTGTTGGCAATACTTTTCAA ATGGCTGAAAACACCTAAAAATTGTTCATTCCGAAATATCTGTCACTGCTCTGTTGCCAA ACTCAGAATAGAACTTAGACGTATGTCTGAGTCCCTGAGATCACATGCTAAAGTCGATGA AAGTAACCACTGCCACTGTCTGTGTCAGAACTTTACAGTACAG | SEQ ID NO: 1211 |
| CALU | ADXCRAD_CX788634_s_at | ATGTCATTGAAAGTGCCTTTAACGAAAGAAATGGTCACTGAATGGGAATTCTCTTAAGAA ACCCTGAGATTAAAAAAAGACTATTTGATAACTTATAGGAAAGCCTAGAACCTCCCAGT AGAGTGGGGATTTTTTCTTCTTCCCTTTCTCTTTTGGACAATAGTTAAATTAGCAGTAT TAGTTATGAGTTTGGTTGCAGTGTTCTTATCTTGTGGGCTGATTTCCAAAACCACATGCT GCTGAATTTACCAGGGATCCTCATACCTCACAATGCAAACCACTTACTACCAG | SEQ ID NO: 1218 |
| CTSA | ADXCRIH.551.C1_at | AAAGTGCCCCTGCAGGCCGGGTTCTGCCGCCAGGACTGCCCCCTTCCCAGAGCCCTGTAC ATCCCAGACTGGGCCCAGGGTCTCCCATAGACAGCCTGGGGGCAAGTTAGCACTTTATTC CCGCAGCAGTTCCTGAATGGGGTGGCCTGGCCCCTTCTCTGCTTAAAGAATGCCCTTTAT GATGCACTGATTCCATCCCAGGAACCCAACAGAGCTCAGGACAGCCCACAGGGAGGTGGT GGACGGACTGTAATTGATAGAT | SEQ ID NO: 1219 |
| ALCAM | ADXCRIH.556.C1_s_at | TAAAACAGAATTTGGTAGCACTTACCTCTACAGACACCTGCTAATAAATTATTTTCTGTC AAAAGAAAACACAGCATGTGTGAGAGACAGTTTGGAAAAATCATGGTCAACATTCCCAT TTTCATAGATCACAATGTAAATCACTATAATACAAATTGGTGTTAAATCCTTTGGGTTAT CCACTGCCTTAA | SEQ ID NO: 1220 |
| KDELR3 | ADXCRIH.3560.C1_at | GTATGTGACCAAAGTCCTTAAGGGAAAGAAGTTAAGTCTTCCAATGCCAATCTGAGGACC TTCAGAGACAGTCTACGCCTTAACAAGCACATGAAGGAAACTATTTTGAATGTTCTCTTT GGCAACTTATCCATAATTTGGGATCAAATGTTAAAACCAGAAAGTGTTTAGTGTGGATT TCAGCAAACCTG | SEQ ID NO: 1221 |
| TIMP1 | ADXCRIH.2934.C1_s_at | TGCAAACTGCAGAGTGGCACTCATTGCTTGTGGA | SEQ ID NO: 1226 |
| TAGLN2 | ADXCRIH.1215.C1_at | TGGCCTTGCTTCTACAAGTATGCTTCTCCCACAGCTGTGGCTGCAGGAACTTAATTTATA GGGAGGAGCCTGTGGCAGCTGCTGCCCCAGCCACAGCTGCACTGACTGTGCTCACCACAC ATCTGGGGCAGCCTTCCCTGGCAGGGGCCCTCGTGGCTTCTCATTTTCCATT | SEQ ID NO: 1230 |
| TAGLN | ADXCRIH.1215.C1_x_at | TGGCCTTGCTTCTACAAGTATGCTTCTCCCACAGCTGTGGCTGCAGGAACTTAATTTATA GGGAGGAGCCTGTGGCAGCTGCTGCCCCAGCCACAGCTGCACTGACTGTGCTCACCACAC ATCTGGGGCAGCCTTCCCTGGCAGGGGCCCTCGTGGCTTCTCATTTTCCATTCCCTTCAC TGTGGCTAAGGGGTGGGGTGAGGGGATGGAGAGGGAGGGCTGCCTACCATGGTC | SEQ ID NO: 1231 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| COL4A2 | ADXCRIH.1229.C1_at | ACTGCCCCACGTTGTCCCTGAGATTTAACCCCTCCACTGCTGGGGGTGAGCTGTACTCTT CTGACTGCCCCCTCCTGT | SEQ ID NO: 1234 |
| COL4A2 | ADXCRAD_BM700172_s_at | GGCCCTGCTTTCTACGCCAATGTTATGCCAGCTCCATGTTCTCCCAAATACCGTTGATGT GAATTATTTTAAAGGCAAAACTGTGCTCTTTATTTTAAAAAACACTGATAATCACACTGC GGTAGGTCATTCTTTTGCCACATCCCTATAGACCACTGGGTTTGGCAAAACTCAGGCAGA AGTGGAGACCTTTCTAGACATCATTGTCAGCCTTGCTACTTGAAGGTACACCCCATAGGG TCGGAGGTGCTGT | SEQ ID NO: 1235 |
| COL5A2 | ADXCRIH.2984.C1_s_at | AATTCGGCGTTGAAATTGGGCCAGTTTGTTTTGTGTAAAGTAAGCCAAGACACATCGACA ATGAGCACCACCATCAATGACCACCGCCATTCACAAGAACTTTGACTGTTTGAAGTTGAT CCTGAGACTCTTGAAGTAATGGCTGATCCTGCATCAGCATTGTATATATGGTCTT | SEQ ID NO: 1239 |
| PRNP | ADXCRIH.1264.C1_s_at | CATAGGACAGACTTAGGAGTTTTGTTTAGAGCAGTTAACATCTGAAGTGTCTAATGCATT AACTTTTGTAAGGTACTGAATACTTAATATGTGGGAAACCCTTTTGCGTGGTCCTTAGGC TTACAATGTGCACTGAATCGTTTCATGTAAGAATCCAAAGTGGACACCATTAACAGGTCT TTGAAATATGCATGTACTTTATATTTTCTATATTTGTAACTTTGCATGTTCTTGTTTTG | SEQ ID NO: 1241 |
| TMBIM1 | ADXCRIH.1270.C1_at | GGAGAAGACACATCTTCAGCCTAGTCCCTGCCAAGCCCACCAAGAGCAACAGTTAGTCCC TAGCTCCTCCGTCCCCACCAAGTACCCACACATCCATAGCCAGAGAGGCCACCTGTCTCC AGGACAGAAAGGAAACTGGGCATGTTACTCAAGGGGAAGGAAAGGGGCCTAAAGCCCAGA CCACAGTCATAGGGCCCAGCCCTCTAGCTTGGAAGGGAGAGCCCAGGATCGGGTGAAAAT GGGGGCTTGCTCCTTAATTGCGATCCC | SEQ ID NO: 1243 |
| ACTN4 | ADXCRIH.2218.C1_at | AGAGCAGGAGAGACGGCAGAGATATGTTGCTAGGTGAATATATATTTATATAATAAATCC GTAAGTTAATAAAGTAAATAGTAATTCTCTG | SEQ ID NO: 1244 |
| ACTN4 | ADXCRIH.2218.C1_s_at | ACCATCAACCACCAGGCAGCCAGGCCATCAGCCCACCTCCACCTCTGGAGGGTCCCCAGA GACCCACGCCCGACGCAGACCCGGAGGAGCATCAGCAAGGGGCCCGGGCAGAGAATCGGC TATGTCTTCATTATGAGA | SEQ ID NO: 1245 |
| CASK | ADXCRIH.3207.C1_s_at | GTATCTCATGACCAAATGATGCAAGACATCTCTAATAACGAGTACTTGGAGTACGGCAGC CACGAGGATGCGATGTATGGGACAAAACTGGAGACCATCCGGAAGATCCACGAGCAGGGG CTGATTGCAATACTGGACGTGGAGCTTCAGGCACTGAAGGTCCTGAGAACTGCAGAGTTT GCTCCTTTTGTTGTTTTCATTGCTGCACCAACTATTACTCCAGGTTTAAATGAGGATGAA TCTCTTCAGCGTCTGCAGAA | SEQ ID NO: 1248 |
| KCMF1 | ADXCRIH.1604.C1_s_at | GGTGATTGTAATTTCAGGTCTGTCACTCTTGTTACATTGTGTACATTCAAAAGGAAGAGA GAAAATATATATGATAATCATTTCCACTTAACTAATTTTTACTTCTAGCAGGTAAATGTA GGTAGCAGTGCAGGGGTGATCTCTGCTTCCTGTACCTTGACATGCAAAAGGCTCTCCTAA TACTCCACATTCAAACTGAAGAGGAAAATTGAAATCTCTAATGAAGCTGCTGTGTGTATT TATGAATATTAATGAATAAAAACTGCTTGGATGGT | SEQ ID NO: 1249 |
| YES1 | ADXCRIH.3214.C1_at | GGCAGGAAAGTTGATGGGATTCATTAGGTTTACTGGATGGAGCAGTTCCCTATATAATAC CAATGGAATAGTAAGGGATAAAACCTACATGTGTATTCTT | SEQ ID NO: 1250 |
| YES1 | ADXCRAD_CX784933_s_at | GCAAGTTGGCAGTGGTTCTGGTACTAAAAATTGTGGTTGTTTTTTCTGTTTACGTAACCT GCTTAGTATTGACACTCTCTACCAAGAGGGTCTTCCTAAGAAGAGTGCTGTCATTATTTC CTCTTATCAACAACTTGTGACATGAGATTTTT | SEQ ID NO: 1251 |
| MAP1LC3B | ADXCRIH.2287.C1_at | AGTGGTGTAATTGTGATTTTCCTGTGATACTCCCAAGAAAACTATAAATAGTGAACCCCA TGCAAGTACTGGGAAGCACTAGTCTTTTATCACAGGTTGAACCTGAGGAGGTTAACTCT TGACATTAGTATCTGTAAAAGAGCGTACGGCTCTTTTTGCTATGTTTTCTCCACAACTGA CATGCACTTGGTGTGGGAGAATTCCGATGGCTGTCTGACCTAAGAGTGATACTACTATTC AAAATGTGGGTACCTTTTCAGTAATACTGA | SEQ ID NO: 1255 |
| SCRN1 | ADXCRIH.243.C1_at | ATAATCGAAATTATGGAGGTTCCTTAGTGCTCAATAATATAAGACCTGTTGTTATTAGAA CGAGTCTTTCTTATAAACTAACAGAGCAGGTATATGCCTGTTAGATCTTAGCTGTGGGGT TCCTTTACTATTGGGTGAATCATTAGGTATAAAAAATAATCATCAACCAGGCCAAATACT TTGCTTCCTAGCTGATGTCATCCCACATTGGTACAGTGTTATTCATTACTGGGTGGTTCA ACAGGGAAGCCAGTGGGA | SEQ ID NO: 1256 |
| SCRN1 | ADXCRIH.243.C1_s_at | GGTTCCTTTACTATTGGGTGAATCATTAGGTATAAAAAATAATCATCAACCAGGCCAAAT ACTTTGCTTCCTAGCTGATGTCATCCCACATTGGTACAGTGTTATTCATTACTGGGTGGT TCAACAGGGAAGCCAGTGGGACCAGTGTGTCTGTCATGAAAC | SEQ ID NO: 1257 |
| SEPT7 | ADXCRIH.335.C3_s_at | TTACACTTTATGGTAAGTAGCAGGGGGGGAAATGCATTTATAGATCATTTCTAGGCAAAA TTGTGAAGCTAATGACCAACCTGTTTCTACCTATATGCAGTCTCTTTATTTTACTAGAAA TGGGAATCATGGCCTCTTGAAGAGAAAAAAGTCACCATTCTGCATTTAGCTGTAT | SEQ ID NO: 1260 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| YWHAZ | ADXCRAD_CV571569_s_at | TTCTGTCTTGTCACCAACCATTCTTACTTGGTGGCCATGTACTTGGAAAAAGGCCGCATG ATCTTTCTGGCTCCACTCAGTGTCTAAGGCACCCTGCTTCCTTTGCTTGCATCCCACAGA CTATTTCCCTCATCCTATTTACTGCAGCAAATCTCTCCTTAGTTGATGAGACTGTGTTTA TCTCCCTT | SEQ ID NO: 1264 |
| YWHAZ | ADXCRIH.776.C2_x_at | AAATATTTCCTCAGTACTTTGCAGAAAACACCAAACAAAAATGCCATTTTAAAAAAGGTG TATTTTTTCTTTTAGAATGTAAGCTCCTCAAGAGCAGGGACAATGTTTTCTGTATGTTCT ATTGTGCCTAGTACACTGTAAATGCTCAATAAATATTGATGATGGGAGGCAGTGAGTCTT GATGATAAGGGTGAGAAACTGAAATCCCAAACACTGTTTTGTTGCTTGTTTTATTATGAC CTCAGATTAAATTGGGAATATTGGCCCTTTTGAATAATTGCCTCGTGC | SEQ ID NO: 1265 |
| RCN1 | ADXCRIH.419.C1_s_at | ATACAATGCATTTCCTCAGTGATCACTGATTAGAATGAGTTGGTGGGATCCTTGGGAAGC CAAACGGAGCGGAGTTCTGGATCATGTCCCATCCAGTCCAGTGAATCCACGACCCGCAGA CCTGCCCCCCCGCAACAGCTTATACCATGGAATGAGGACAAGGTGATACTCTGAGCTGTG GACTGAACTGGCAGACACAACCTGTACAGATTGAAATTTCACCTTGTAA | SEQ ID NO: 1269 |
| ZFP36L1 | ADXCRIH.786.C2_at | TCTCAAGACATTCCACTCACAGATTTGAGGTTCTGGATTCCAGGTCTGGAGTTTTCCCAT GTTAATGTAAACAGAACTGGCACACACACATTAAAGATGAATGTAATTATTATTCCTCTT GCTGGTCACTACCGTCGCTTTCTATTTCTCTTTCTTTGTGTGAATTTATTTNNNNNNNNN NNNNNNNCCTTTTGTAACGACTATTTGCAGTTTAAAATC | SEQ ID NO: 1270 |
| ZFP36L1 | ADXCRIH.786.C2_x_at | GAGAAACCCTTTGACTTCCACGTGCCCATCTCAAGACATTCCACTCACAGATTTGAGGTT CTGGATTCCAGGTCTGGAGTTTTCCCATGTTAATGTAAACAGAACTGGCACACACACATT AAAGATGAATGTAATTATTATTCCTCTTGCTGGTCACTACCGTCGCTTTCTATTTCTCTT TCTTTGTGTGAATTTATTTNNNNNNNNNNNNNNNNNCCTTTTGTAACGACTATTTGCAGTT | SEQ ID NO: 1271 |
| CAV1 | ADXCRIH.1095.C2_at | TTTATTCCTCCTGCTCATATTGTGATTCTGCCTTTGGGGACTTTTCTTAAACCTTCAGTT ATGANNNNNNNNNCATACACTTATTGGAACTCTGCTTGATTTTTGCCTCTTCCAGTCTTC CTGACACTTTAATTACCAACCTGTTACCTACTTTGACTTTTTGCATTTAAAACAGACACT GGCATGGATATAGTTTTACTTTTAAACTGTGTACATAACTGAAAATGTGCTATACTGCAT ACTTTTTAA | SEQ ID NO: 1272 |
| PRSS23 | ADXCRIH.795.C1_at | GGATCAGAATCATGCCTTCCAATAAAGGCCTTTACACATGTTTTATCAATATGATTATCA AATCACAGCATATACAGAAAAGACTTGGACTTATTGTATGTTTTTATTTTATGGCTCTCG GCCTAAGCACTTCTTTCTAAATGTATCGGAGAAAAAATCAAATGGACTACAAGCACGTGT TTGCTGTGCTTGCACCTCAGTAAACCTGCATTGTAGCAATTTGTAAGGATATTCAGATGG AGCACTGTCACTTAACATTCTCTGGG | SEQ ID NO: 1275 |
| ANXA2 | ADXCRIH.511.C2_s_at | TAGAAAACCAGCTTGCGAATAACAGTCCCCGTGGCCATCCCTGTGAGGGTGACGTTAGC | SEQ ID NO: 1276 |
| GJA1 | ADXCRIH.1842.C1_at | GTGATGGTAATGATATTGTGCAAGTGGATGGAAAAAGAATATACGTATTTGCAAATGCAT GGAAAATCTTATTCTGTGGGCCTTGTCTGAATTTTAAACTGATACCAAGAATAAAAAAT ATAGTAGCACAAGTCCATTGACACCTGGAGGGTCAGGCCTAGAAAGCTTACCTTCAAAGT GCAAATTTTAACAATGGAATGTTTTAGCAGGGACTTAAGCCTCGTGC | SEQ ID NO: 1277 |
| SLC20A1 | ADXCRIH.3036.C2_s_at | CAGTAGTGGCAGGATCTATTGGCATATTCGGGAGCTTCTTAGAGGGATGAGGTTCTTTGA ACACAGTGAAAATTTAAATTAGTAACTTTTTTGCAAGCAGTTTATTGACTGTTATTGCTA AGAAGAAGTAAGAAAGAAAAAGCCTGTTGGCAATCTTGGTTATTTCTTTAAGATTTCTGG CAGTGTGGGATGGATGAATGAAGTGGAATGTGAACTTTGGGCAAGTTAAATGGGACAGCC TTCCATGTTCATTTGTCTACCTCTTAACTGAATAAAA | SEQ ID NO: 1282 |
| JUN | ADXCRIH.716.C2_at | GATGAAAAGCTGATTACTGTTCAATAAACAGCTTCCTGCCTTT | SEQ ID NO: 1287 |
| JUN | ADXCRIH.716.C2_s_at | CAAACTGCAATAGAGACTGTAGATTGCTTCTGTAGTACTCCTTAAGAACACAAAGCGGGG GGAGGGTTGGGAGGGGCGGCAGGAGGGAGGTTTGTGAGAGCGAGGCTGAGCCTACAGAT GAACTCTTTCTGGCCTGCCTTCGTTAACTGTGTATGT | SEQ ID NO: 1288 |
| DNAJB1 | ADXCRIH.815.C2_s_at | TGGGGCTTACCAGTGGCCCAGGTAATTTTTGTTTCATGGACTATGGACTCTTTCAAAGG GATCTGATCCTTTTGAATTTGCACAGCCCTAGATACAATCCCTTTTGATAAAAGGGTCT TTGCTTCTGATTACAGGAGCACTGTGGAACGTCTGTAAATATGTTTTTATATTTCCATGT ATAGTTGGTGTACACTCAAAACCTGTCC | SEQ ID NO: 1290 |
| S100A10 | ADXCRIH.249.C2_at | GGCAGAAATGAGCAGTTCGCTCCTCCCTGATAAGAGTTGTCCCAAAGGGTCGCTTAAGGA ATCTGCCCCACAGCTTCCCCCATAGAAGGATTTCATGAGCAGATCAGGACACTTAGCAAA TGTAAAAATAAAATCTCATTTGACAAGCAGAGAAAGAAAAGTTAAATACCAGAT AAGCTTTTGATTTTTGTATTGTTTGCATCCCCTTGCCCT | SEQ ID NO: 1295 |
| SPTBN1 | ADXCRIH.820.C2_at | CTGTACCTCTCAACTTTTGCCCTATCTGTTAAATATATGCTAT | SEQ ID NO: 1296 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| SPTBN1 | ADXCRIH.820.C2_s_at | GTTACTCTAATGGTTACTTGCTCGTGCGTTGCCACACTGTGTTATAATTTGCTTCATTTC CTTGCTATTTGATACATAGTGTGCATTTCTCTGTCACTGTAACTATTGTAATGACAAATT TTCATCTTACTGCACAATCAAAATGACATTGATAGGAATGAACTCCAGAGGCTGGGCCTG AACAGGGAGGTGGTCGCTCAGGCCTGGTGCTCAGTCGTACGACCTGTACCTCTCAA | SEQ ID NO: 1297 |
| MARCKS | ADXCRIHRC.653.C1_at | TTTTTGATCCATTATTCCAATTAAGAATGCGTGTCAAAACCTAATTTGTTATTTTTCTAA TGAGTTTAAGATTTGGCATTCAGTTGTTACACATGTGGTTCAATGATTTATCATGAACCC TAAACTGCACACTGCTCAAAAACAGCAAAACAGATGTGCATTAAATGAATAATGTTTTT GATACATATCTTAAATTTCAATCAGTTTAGGGTCCTTTGAAGGAAAAGATATCCAGTTAT CGGGTGGCAAAGAGCAGAGGAGGTAAACTCCTCGTGCCG | SEQ ID NO: 1305 |
| IL8 | ADXCRIHRC.2782.C1_s_at | AACAATCCTAGTTTGATACTCCCAGTCTTGTCATTGCCAGCTGTGTTGGTAGTGCTGTGT TGAATTACGGAATAATGAGTTAGAACTATTAAAACAGCCAAAACTCCACAGTCAATATTA GTAATTTCTTGCTGGTTGAAACTTGTTTATTATGTACAAATAGATTCTTATAATATTATT TAAATGACTGCATTTTTAAATACAAGGCTTTATATTTTTAACTTTAAGATGTTTTTATGT GCTCTCCAAATTTTTTTTACTGTTTCTGATTGTATGGAAAT | SEQ ID NO: 1310 |
| TNFRSF12A | ADXCRIHRC.3000.C1_s_at | ACTTGGGGGGCAGACTTGACACTAGGCCCCACTCACTCAGATGTCCTGAAATTCCACCAC GGGGGTCACCCTGGGGGTTAGGGACCTATTTTTAACACTAGGGGCTGGCCCACTAGGA GGGCTGGCCCTAAGATACAGACCCCCCCAACTCCCCAAAGCGGGGAGGAGATATTTATTT TG | SEQ ID NO: 1311 |
| VIM | ADXCRAD_CX873552_s_at | AAGCAGGAGTCCACTGAGTACCGGAGACAGGTGCAGTCCCTCACCTGTGAAGTGGATGCC CTTAAAGGAACCAATGAGTCCCTGGAACGCCAGATGCGTGAAATGGAAGAGAACTTTGCC GTTGAAGCTGCTAACTACCAAGACACTATTGGCCGCCTGCAGGATGAGATTCAGAATATG AAGGAGGAAATGGCTCGTCACCTTCGTGAATACCAAGACCTGCTCAATGTTAAGATGGCC CTTGACATTGAGATTGC | SEQ ID NO: 1312 |
| SVIL | ADXCRIHRC.3823.C1_at | ACCGGTTGTAAAAACAGTACACATGTCATTTTGTGATATAGGACTCCCAAATAAAAGTAT CAGAATAAACACCTCGTGC | SEQ ID NO: 1314 |
| SVIL | ADXCRAD_CN402078_s_at | GTATCTTCATACACGTTTGGAAATGTTTCCTGCAGCATTAGGTATGACTTGTTCTGAGTA CTGCTTCCGGTGCTAAAATGAACAAAGAATTTGTACTTAATGGCATGGACTCTGGAGAAT CTATGCGAATCAACCTTTCTACCTTAATATCTCCCAAAAATGTATAGTGCCTTGTTTTT ATGTACAGTTTATATACAGAAAAGTTTGCTCTGCATTTTTGATGATGGTTTGGAACATTA TCTACAAT | SEQ ID NO: 1315 |
| LGALS1 | ADXCRIHRC.2899.C1_at | AACACCATCGTGTGCAACAGCAAGGACGGCGGGGCCTGGGGGACCGAGCAGCGGGAGGCT GTCTTTCCCTTCCAGCCTGGAAGTGTTGCAGAGGTGTGCATCACCTTCGACCAGGCCAAC CTGACCGTCAAGCTGCCAGATGGATACGAATTCAAGTTCCCCAACCGCCTCAACCTGGAG GCCATCAACTACATGGCAGCTGACGGTGACTTCAAGATCAAATGTGTGGCCTTTGACTGA AATCAGCCAGCCCATGGC | SEQ ID NO: 1317 |
| PTPRK | ADXCRIHRC.91.C1_s_at | CAATGCCAGATTCCTGTTTTGCGCATTGTCATGGGATTCTTAAGTGAACCTTTCTAAATG TGGTCTTGTTCACATGCTCCACGTAGCTGTAACTTCACATCATCAGCTTGCAGTTTGTAA TTGACTAAAGCATTCCAGTGTCCTCTTTCTAGATTGCCAGCTCATGACATGGTGCTTATA AAGA | SEQ ID NO: 1318 |
| RRAS | ADXCRIHRC.3859.C1_at | GAGAGAAGCAACCACCACAAGCTCTCGGGACTAGCTGCCTTCGCACCTTGCTGTGTGACC TGAGGCCCTCACTGAGCCTCAATTTCCTCATCTGGGTCTCCCAGGACACATCACATACCC ACCCTTACTTCCTGGCCTCTTCTGGGCTACTGCCACTGTGTGCCTTCTGCCAACGCCTCC TGTCCCCACCTAAGCCTGGTGGGGGTGAGGGGCTCCGGGTCACTGCTGTATATAACTCCC CTCCCCCAGAAAAATAAATGTCACTGCCAACGTCCTCGTG | SEQ ID NO: 1319 |
| ACTN4 | ADXCRIHRC.2218.C1_at | ATATTCACCTAGCAACATATCTCTGCCGTCTCTCCTGCTCTCATAATGAAGACATAGCCG ATTCTCTGCCCGGGCCCCTTGCTGATGCTCCTCCGGGTCTGCGTCGGGCGTGGGTCTCTG GGGACCCTCCAGAGGTGGAGGTGGGCTGATGGCCTGGCTGCCTGGTGGTTGATGGTTTTG CCTCGT | SEQ ID NO: 1326 |
| MAP1LC3B | ADXCRIHRC.2287.C1_at | ATGTATATTCTTAACTGGACTGTCTTGTTTAGACTGTATACATCATATCCGACATTATTG TAACTACCGTGTGATCAGTAAGATTCCTGTAAGAAATACTGCTTTTTAAGAAAAAAATA ACATGCTGAGGGGTGACCTATATCCCATGTGAGTGGTCACTTTATTTATAGGATC | SEQ ID NO: 1327 |
| YWHAZ | ADXCRIHRC.776.C2_at | TACATGAATTTAATACACGTGTTCTTAACAATTATGCTTGGATTGTTCATGAAAATTTCA TAAGACATTAAACAAAGCTAGCCATCATCTCAAGTTATTTCCCTGTTAACTATTTTTACA GCACACATGCTGTTAGGCAAGTATCNNNNNNNNNNNNNNNNNNNNNNNNNNNNNNNNNNN NNNNNNNNNNGTTAAATACATGGGTTTTTGTTTTACTGCTGTGCTTGATATACATGAAGTA ATGCCTCGTGC | SEQ ID NO: 1328 |
| YWHAZ | ADXCRIHRC.776.C2_x_at | AAACTTTTATTCCACTTACATGAATTTAATACACGTGTTCTTAACAATTATGCTTGGATT GTTCATGAAAATTTCATAAGACATTAAACAAAGCTAGCCATCATCTCAAGTTATTTCCCT | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | GTTAACTATTTTTACAGCACATGCATGTTAGGCAAGTATCNNNNNNNNNNNNNNNNNNNN NNNNNNNNNNNNNNNNNNNNNNNNNGTTAAATACATGGGTTTTTGTTTTACTGCTGTGCT TGATATACATGAAGTAATGCCTCGTGC | 1329 |
| GJA1 | ADXCRIHRC.1842.C1_s_at | TGAAGACATCTACCAGTTTCTCCCAAATGCCTTTTTTAAAACTCATCACAGAAGATTGGTG AAAATGCTGAGTATGACACTTTTCTTCTTGCATGCATGTCAGCTACATAAACAGTTTTGT ACAATGAAAATTACTAATTTGTTTGACATTCCATGTTAAACATACGGTCATGTTCAGCTTC ATTGCATGTAATGTAGACCTAGTCCATCAGATCATGTGTTCTGGAGAGTGTTCTTTATTC | SEQ ID NO: 1330 |
| CAST | ADXCRIHRC.622.C3_at | AGAAGGCATATTCAGAGTTCTTTTTAAATAAATGTTGTTTACTTTTATAGGCATCTTTAA ACTTCTGGATTTTGGTATGCCATTTAAAAATACTTCCAGATACACATGGAAATTAGTAAT ACTGCAGCCGTATCCTTGCAAACACATCTGTCAGTGTCAAAGGTTTCAAGGTTTTTCTTN NNNNNNNNNNNNNNNNNNNNNNNCACCTATACTGCCCAAATGGGAGGATTAGATACATGG TTAGAAATCCCTCAGGAAA | SEQ ID NO: 1333 |
| PPIC | RDCR013_A07_at | CATTTATGCATATTTCTCTATACTGTCTTTTACATGCACAAGACATTTGAAGTAATATAC TGTAAAACTGTACAATTAAAATTATAAATAAAATGTAAGACCATGACATGAAATCCAAAC AGTACATGGATGAATTATAAGAAGATTAGCTAATCTGCTAGCAGTTATCTTTTGTAATAC TA | SEQ ID NO: 1337 |
| PPIC | RDCR013_A07_x_at | GCCTGGCCCAATTACTTTCATTTATGCATATTTCTCTATACTGTCTTTTACATGCACAAG ACATTTGAAGTAATATACTGTAAAACTGTACAATTAAAATTATAAATAAAATGTAAGACC ATGACATGAAATCCAAACAGTACATGGATGAATTATAAGAAGATTAGCTAATCTGCTAGC AGTTATCTTTTGTAATACT | SEQ ID NO: 1338 |
| FNDC3B | RDCR250_A04_at | ATGGATTAACCTCGTTAACAAGAAGAAAAGGCAATTGTGATTTCTAAAGTGGAAAGGCAG GTAGGTTGCAAAGACTCCCCTACACTGAAAATACGATTCTTTTCCATTCTCAGCTGTAAT TGCTGAAAGCTCAAGTAATAGGCTAAGGTAACATACAAGGCCTAAAACCTTATTCCTTTA TCATTCAGTACTGAACGTTCCTCTAAGAGACTGCACTTTTTCCCGCCACCTCAAAAACAG CCCTGAATCAAGCCTGGCCTGCCCACTTCAGCAACACTAGCCCAGCTACAG | SEQ ID NO: 1340 |
| MARCKS | RDCR156_A02_at | GAAGTGAAATAATCATGCCTGCCCTGGCTGCTTCTGTGAGTGGAAGATCATAATTGGAGT GCATGAAAGACTTTGTAAACTGTTAAGTGCTCTATAAACGTTAGCATTTTACTCAATAAA TTTTTTATCACACATTCGATGGAATAAGGAAAGAGAATTGAAATAATACAGTTTTTCTTCA TTGCCTTAGATTATAATTCAGATATAATACAGTTCATTACATTTCATAGTTGTGGCTATT TCAGTAAAT | SEQ ID NO: 1347 |
| MARCKS | RDCR156_A02_x_at | AGTGAAATAATCATGCCTGCCCTGGCTGCTTCTGTGAGTGGAAGATCATAATTGGAGTGC ATGAAAGACTTTGTAAACTGTTAAGTGCTCTATAAACGTTAGCATTTTACTCAATAAATT TTTTATCACACATTCGATGGAATAAGGAAAGAGAATTGAAATAATACAGTTTTTCTTCATT GCCTTAGATTATAATTCAGATATAATACAGTTCATTACATTTCATAGTTGTGGCTATTTC AGTAAAT | SEQ ID NO: 1348 |
| MAPK1 | RDCR077_G03_at | GTATGTTCAAATAAGCTTTCAGACTAATAGCTTTTTTGGTGTCTAAAATGTAAGCAAAAA TTCCTGCTGAAACATTCTAGTCCTTTCATTTAGTATAAAGA | SEQ ID NO: 1349 |
| MAPK1 | ADXCRPD.11685.C1_s_at | ATTCCCCTTCCTGGTACTGTGGAGTCAGATTGGCATGAAACCACTAACTTCATTCTAGAA TCATTGTAGCCATAAGTTGTGTGCTTTTTATTAATCATGCCTAAACATAATGTAACTGGG CAGAGAATGGTCCTAACCATAGGTACCTATGAAAAGCGCTAGCTATCATGTGTAGTAGAT GCATCATTGTGGCTCTTCTTACATTTGTAAAAATGTACAGATTAGGTCATCTTAATTCAT ATTA | SEQ ID NO: 1350 |
| COL5A2 | RDCR149_E06_at | AAAGGGCAAGCAATAGATTTTTCATGACTGAATAAACTGTAATAATAAAACATATGTCTC AAAGTGTATCACATATGAATTTAGCCTAATTGTTTTCAGTTTCATTCTCAATATTTAGTT TACAACATCATTTTCCCCTAAACTGGTTATATTTTGACCTGTATATCTTAAATTTGAGTA TTTTATATGCCTAAATACATGTGTGAGTTTTGTTTGACTTCCAAGTCCAAACTATAG | SEQ ID NO: 1356 |
| COL5A2 | RDCR149_E06_x_at | TGCCCTTAAAAATGTCAGAGTAGTATTATTGATAAAAAGGGCAAGCAATAGATTTTTCAT GACTGAATAAACTGTAATAATAAAACATATGTCTCAAAGTGTATCACATATGAATTTAGC CTAATTGTTTTCAGTTTCATTCTCAATATTTAGTTTACAACATCATTTTCCCCTAAACTG GTTATATTTTGACCTGTATATCTTAAATTTGAGTATTTATATGCCTAAATACATGTGTGA GTTTTGTTTGACTTCCAAGTCCAAACTATA | SEQ ID NO: 1357 |
| CAV2 | RDCR300_A12_at | GGTTCGGCATTCATGTGTATTCCATTCNNNNNNNNNCTCTGTACTTTCTTTTCATACATT TCTTGTCTCTGCAATGAGGCTGAGCGAGACTGTCCCAAATGTGTTTTTATCCTGAGTCTG AGGCAGGCTGAACTTTAATCTGCATGATGTGCTGCAGCTTGCCATCATGTCGGGACAGCA GATCCAGTCCCTTGAGTAAGCCAGTTGGTCACAGTTTCAGA | SEQ ID NO: 1364 |
| SDC4 | RDCR312_B10_at | ACCAAAGGCTACCTTGCCTAAAATGTTAGTGGCTGAGGACCCAAGCCTTCTGCCTCTAGC ACAGTGCTCTAAACTAGGCCCTGAAGGATGTGTCGGGTCAAGCCACTGGGGAAGCATCCG AAGGGATACCACCTAGGCAGTACAGGGAAAAAGAGGAAAGGACCCAGGAGGTTGCTGAGT CACCGTGTGCCCAGTCACATGCCAGTTTCCTCCCAGGGGCTGCTGAGCTTTCAAGTGCTT CAGGGTGCTGAGCAGTC | SEQ ID NO: 1365 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FNDC3B | RDCR337_C02_at | TATTTACCATTTTACTATCCAGAGATGATAATCACTCTGCTAACATGTTTTTGATTATAT CCTTCCAGATGGATTTTTCTTTTCTCTACTCTTTCTCTGTCTCTCAGCCTCTGCTTTTAA AGTGGTTTAAAATATGTAATTTTCAGTTTTTAATGATTCTGCTAGGGCGAAAAATTGGCA GCTACATAGGAAAGTTGCTGAAGCGGAGGCAAGGAATCAAAGATTTATCCTTCTCTGATA TAAAAACTTACCCATTTTTTCAAGTGTAAGGCATATTGCAGCCACTAATA | SEQ ID NO: 1366 |
| KCTD12 | RDCR348_G10_at | GGGAGGAAGAACTGGTGAAATGAAGTGAGTGCCTTTGAGAATTGAATGAATTTAA | SEQ ID NO: 1367 |
| KCTD12 | RDCR348_G10_s_at | GTAAAACACCATTCAAGTGTCAGAATCATTATTTTCCACCACTTATCATGGTGCTTGACA AGTCTTCCCAATAAATACTGAATGAAC | SEQ ID NO: 1368 |
| PTPRK | RDCR460_E08_at | AGAAATATGCCTTGCCTTCAGAGAATTTATAGAAAGTCTATCTGTCAGTGCTAGGGTGCT AGGGGCTGGGAGGAGCTGAGAGCAGCTCTAAAGCCAGGAAGCTGGACCTAAAACAGATGG CTATTGAGCGAAGTATTTGAAGCTAGATGATGTGTAAGTAATAATATTCTCTGAGCACCT CTATTATTATTTTTTAGGTTCTCTGCATCAGAATGAGGAAAGAGATTTAATAAGTTGTGA ATTTTAAATTCATGAGAATGCCAATAGAGACC | SEQ ID NO: 1370 |
| ANXA2 | RDCR471_F01_at | CTGTGAGAGCATGAAGCTGCAACAAGTCAGTAGGGGAGCAAACAAATATTGATTCAGATC ACGCCACAGAAGAGACAAGCTGGAGCAAGTGCTGTGTGTCCCTCCTGCTCAGTTTGATCG AGGTCACTGGGCCGAATTCCAGGAATTCTGGGGAATGAGTTGGCCCTGTGACTCAGTCAT TAATCAAGACCATAAAACCAAGGAGAAGAATATCTGCTTTCAAAAAGGTTCTGATAATAA AGATGCAGTACGTGGGTGGAGGATGGAGTACAGTGGGAACCCCTCTTCTC | SEQ ID NO: 1371 |
| SDC4 | RDCR488_B09_s_at | AGTGGCCATTAGCTCCCGTCACCACTGCAACCCAGGGTCCCAGCTGGCTGGGTCCTCTTC TGCCCCCAGTGCCCTTCCCCTTGGGCTGTGTTGGAGTGAGCACCTCCTCTGTAGGCACCT CTCACACTGTTGTCTGTTACTGATTTT | SEQ ID NO: 1372 |
| FNDC3B | RDCR512_D06_at | GAGTATTTGTGAATTAAATCCTTTATGAAAAGGTGTCCCTTGTAAATGATTGGGGCATGT TGCCTCTTTTCCTTCATATTTTAGTTTCTGCTATTCATAAGAAAATAAGAAAAATACTA ACTTCCCTTAAGAGTAACTACTTAATGTCCAAAAACCCCTCAGGTTCTGCAACTATGATG CACTGATTTATGATGTTTATTTATATACCTCTCAGAAAATTTGAAATGACCAAGAGATTT ACAAATGCAATGTTCAG | SEQ ID NO: 1375 |
| FNDC3B | RDCR512_D06_x_at | GAGTATTTGTGAATTAAATCCTTTATGAAAAGGTGTCCCTTGTAAATGATTGGGGCATGT TGCCTCTTTTCCTTCATATTTTAGTTTCTGCTATTCATAAGAAAATAAGAAAAATACTA ACTTCCCTTAAGAGTAACTACTTAATGTCCAAAAACCCCTCAGGTTCTGCAACTATGATG CACTGATTTATGATGTTTATTTATATACCTCTCAGAAAATTTGAAATGACCAAGAGATTT ACAAATGCAATGTTCAGCCAAAAATGTTTTT | SEQ ID NO: 1376 |
| CD44 | ADXCRIHRC.1441.C1_s_at | GAAGAAGAAAAGCTCCTGACTAAATCAGGGCTGGGCTTAGACAGAGTTGATCTGTAGAAT ATCTTTAAAGGAGAGATGTCAACTTTCTGCACTATTCCCAG | SEQ ID NO: 1379 |
| MYL9 | ADXCRIHRC.2136.C2_s_at | CCACACAAATGCAAGCTCACCAAGGTCCCCTCTCAGTCCCCTTCCCTACACCCTGACCGG CCACTGCTGCACACCCACCCAGAGCACGCCACCCGCCATGGGAGTGTGCTCAGGAGTCGC GGGCAGCGTGGACATCTGTCCCAGAGGGGGCAGAATCTCCAATAGAG | SEQ ID NO: 1381 |
| ACTN4 | ADXCRIHRC.2359.C2_s_at | AGCAGAGGGCGCCACCACCACCTGACGGCTGGGGACCCACCCAGCCCCTCTCCCCTCTCT GCTCCAGACTCACTTGCCATTGCCAGGAGATGGCCCCAACAAGCACCCCGCTTTTGCAGC AGAGGAGCTGAGTTGGCAGACCGGGCCCCCCTGAACCGCACCCCATCCCACCAGCCCCGG CCTTGCTTTGTCTGGCCTCACGTGTCTCAGATTTTCTAAG | SEQ ID NO: 1383 |
| FLNA | ADXCRPD.16964.C1_at | TGGGCTGTCACTTTTGCTGGCGTCACCCTGTGACTTATCCACGTACACCTCGAAGGGGCT CTTGGCGATGTGCTGGCCAGCAAAGAGCACAGTAACCTTATGAGTCCCGTCAACTCGGG GACGTACCAGACGGAGAAGGTGCGGTTCTTGTCGTTATTGGCGGTCACTTTTGCCTCCTC CTGGTGTCCGGCCGGGTCCTCCACGTACACCAGCACCTCTCCCTGGCCAGCACCTCTGGT CTCCACAGTGAACTCTACCCGCTTCTTCACAATGCACGTGATCAAATCCTGTAGAGTC | SEQ ID NO: 1387 |
| FHL1 | ADXCRPD.16965.C1_at | GGGCCCTATGAACAGACCATTCCTGGGGACCGAATACCTTGCTTTCCACCTGCAAAAAAA GTCTCCCTGGGAAATCCTGGCCCAACAAAGAGCTTTGTTNTTTCCCCCCAGCGAACAAA GGGTATTTGTCCCTGAATGTGTGCCAAAAAACACGTGTAAACACTAACAAGGAGGCTCTC TTGGACCTTCGAAAAAAGGGCAATTGGAAATCTCCGGCCCCTTTTGAGGCCCTTGACTTT CATGGCCCTCATCCCCAGTCGATAAGGG | SEQ ID NO: 1388 |
| WDR1 | ADXCRPD.16980.C1_at | GAAGGTGGAGGTCACTCTCCAAAGAAGCATCTCCAACTACTCTTGGGCAAGGCATCTCT CCAGTAGTCTTACGCATGAGGCTAAACCTCTTCTCTTACCTCAAAGATGGCTTCAGTATC CCTCCCGTTACCTNCAACAGGGCATNGAAATGTACCAAAAGCAACACACAGGAGGCCACA GTGGGGCTGAGAGGACCCAGGTACACATGCTGTTTCCTGCCTGGTTTCTCCCCACCTCTG CCGTGTGTCATCAACGCTCCT | SEQ ID NO: 1390 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| SDC4 | ADXCRPD.16987.C1_at | GAAACTCTGCCCCTCCGGAACAGGAGGGTGACCCCAGGTCCTGGACAGGTGTCCAGAGTG GTCTGATACCCTTGGCAAACCCCTGCCCCCTCTCCCTCCAGGCTGCAAACTGTTCAGCA TGAGGCTCCAGCAAATCCCAGCAGGAGAGGTGGGGCTGCCCAGCAACTGGTTCTTGTATA AACATAAACCCATTCGATAATTAGCAAACAGCCCACTTCTAAGATAAACAAATAGGAGAT TTGGACTCCAAAAGC | SEQ ID NO: 1391 |
| AHNAK | ADXCRPD.16988.C1_at | AAATCGGTCGCAGCTAGTGCACTTTGTTCATCATATGTATCTGTGACAGGAACTGAGTCT TAAATCTCCCTGTCTGGCACATGGGTGCGTGAGTGATGTGAGGTCACCGTCTAACGCAGC GTGTAATTAGGTGCTGGGACCAGTTGTGTCCATCCCTGGCTGGTTCCGTCTGTAATGCAA AGTATAGTGTAGGGCATATGGAGGCAGCCGGTATACATGCATTGATTGACTGTTGATACT TTCCGGATGTAA | SEQ ID NO: 1392 |
| CAST | ADXCRPD.1324.C1_s_at | GATCAGCTGAACAGCAGCCATCAGAGAAATCAACAGAACCAAAGACTAAACCACAAGACA TGATTTCTGCTGGTGGAGAGAGTGTTGCTGGTATCACTGCAATATCTGGCAAGCCGGGTG ACAAGAAAAAAGAAACAGAAATCATTAACCCCAGCTGTGCCAGTTGAATCTAAACCGGAT AAACCATCGGGAAAGTCAGGCATGGATGCTGCTTTGGATGACTTAATAGATACTTTAGGA GGACCTGA | SEQ ID NO: 1395 |
| FOXN3 | ADXCRPD.8652.C1_at | TAATCGGATGTCAGGCAGAGAAAACGTCGAGGTCACTCGTCTTCCTGAAGGGCCTTGGAG AAACCGCTGCCCCCGTAACACTGACTCAGTCCACTGGAGACACTAATTCCTGAGCTTTCT GGCTTCTTACTGGGAGGCATGACTGGACCCATTTACGTGAAGGCTCCTGGCCGGAGCGGG GCACGGGGGTGCGGGGCGCCGCTGCCCTTCAGCAGGAGCCGACAAACTTTCGCGGGCG | SEQ ID NO: 1405 |
| RAB31 | ADXCRPD.8667.C1_s_at | GATTGGATTAAAGACCTGGCACTTCAGTAACTCAGCACGCTTCCACTTCACTCAACTTAA GAGAGTTCATTGACAGTGTTAGGATGTGAAGGCTGGGAAACACTTATTTTGCTTCAAGAG TTCCACTTGGCTCTCCCAAATAGGTACCTCAAAAACTGTTAGCAAGCGGCATTTGGATGT CTTGACAGGGGCTTTGCAGGGATTTTTAGGGTTTTTTCCACATTGTCCACATTAATGGTT GGCATGATTGTGCTTGCAGGCCAAGAAATGATCATACCCCTTGCCAA | SEQ ID NO: 1406 |
| EPHA2 | ADXCRPD.8668.C1_at | ATTGTATACAGCGTCACCTGCGAACAGTGCTGGCCCGAGTCTGGGGAATGCGGGCCGTGT GAGGCCAGTGTGCGCTACTCGGAGCCTCCTCACGGACTGACCCGCACCAGTGTGACAGTG AGCGACCTGGAGCCCCACATGAACTACACCTTCACCGTGGAGGCCCGCAATGGCGTCTCA GGCCTGGTAACCAGCCGCAGCTTCCGTACTGCCAGTGTCAGCATCAACCA | SEQ ID NO: 1407 |
| LAMB1 | ADXCRPD.11010.C1_at | ACTGGCACTGGCCTCCGTTGGGATCACACACGGAACTTAACGAACCCTGAGGGTCGCATT CACAAGCCAGGCCTGTCTGGTGTAACAGGGCAGAAATGCTAAAGATGATATTTCTGCAAA CATCTGTCATCGGGGTTTTCACAAACGCTTCTGCTGTTCTCTAGACATCGGTATCTCTGA AAGGTTTCCCAGGCACTGTTGGTGACCACCCCATCTCCTGAACCTCCCACGGTGAAGATG TCCAGTGATTTACAGTAT | SEQ ID NO: 1408 |
| FHL1 | ADXCRPD.11024.C1_s_at | TGTGCTTTCAAATAACTAACACGAACTTCCAGAAAATTAACATTTGAACTTAGCTGTAAT TCTAAACTGACCTTTCCCCGTACTAACGTTTGGTTTTCCCCGTGTGGCATGTTTTCTGAGC GTTCCTACTTTAAAGCATGGAACATGCAGGTGATTTGGGAAGTGTAGAAAGACCTGAGAA AACGAGCCTGTTTCAGAGGAACATCGTCACAACGAATACTTCTGGAAG | SEQ ID NO: 1409 |
| IGFBP3 | ADXCRPD.2051.C1_at | GGCTCCCGAGATGAAACCCGACGTGAACACCACACCCGCGCCCGCCGCACCAATGATCTG ATAACTCTCTAGACAAATAGGGGGCTCGGTCGGGAGAGTCTGAGCCGCCAAATCATCTC AACACCGCTTGCTGCCTCGGCGCCTCNCTGTCGATGATGACATGCGTACACCTCTCTCCT CACGACGACAAGGAGCCTTAGGTGGGACGAANACACAACGCGCACGCACCAATCGCGCGA GCATGCACACGTATAAGACCC | SEQ ID NO: 1411 |
| RAB31 | ADXCRPD.2065.C1_at | AATGCGCCGGCCTAACAATAGTTATAAAAAATTGGGGGGAGGACAACCTCCCCTTCCCCC TCCCGGATCCCCCGCCCGCCTTTTTTTTCCGCACTATTATCCGCCTCTGCCCCGCCGCCT CAGAATACCTCTATCCCGCCGCGGAGAAATTNATTCGCGCCCCGTATTTTCTGCCCGCCG CGAACACGCCCGCCAACCAGTATTCTCGGGAAAATAATATAATGGGACTCAAAAACACCG CTCCCCGCCCAAATACGAACGTCGCGGTGGTTATTACTTCTCGCCC | SEQ ID NO: 1412 |
| ADAMTS1 | ADXCRAD_BM930186_s_at | TCCAGCAGCTGGTCCAACAGTCGTATCCTGGTGAATGTCTGTTCAGCTCTTCTGTGAGAA TATGATTT | SEQ ID NO: 1413 |
| CKAP4 | ADXCRAD_CF130614_s_at | CAAGGAATGCACAGGTTTCGACTACCAGAAAGGGGAGTCCTTGGGTTCTTTCAAAAAATT CGTGAGGAGAGCTGTCTACAGTGGAATAGGGGGTCTCCCTGGGAATGCAGGCCAAGTCC TTTTATTTTAACATGATGTCCATGAAGAGGTTTGCCGTCTGGGCAGCCCTGTCGGCAAGG AGCGTGCATACTGCGTTTGTGTAATTGTTTGCTGTATCTCCCTTCCCTCTGAGCTGTATT GTTCTTTAATGGCTGTCTTGCC | SEQ ID NO: 1414 |
| FOXN3 | ADXCRPD.10462.C1_s_at | GTTCTGTTATGTTCATGTAAACCTAAAGAAACAGTGTGGAGGCAGGCGCGATCAGCCGAA CTCTAGGGACTTGGTGTTGATTTGGAAGGCATCCATACCTGCATTTTGCATTGTTGTATG TAATCATATTGCCAAAGACAAATATTTCATCATTTATTGTAAATAACACTTTTCCCCAG ACCTACCATAAAGTTCTGTGATGTATTGTCTTCCAGTTGCAAT | SEQ ID NO: 1418 |
| MXRA7 | ADXCRPD.17734.C1_at | AAAGGCCTCTAACCTGCTGGAAGATAGGGACCAAGTTGAGTATTTTATTTCTTCTGTCTA CAGCATCCAGCATAGTTCTAATTAAATACAATTAGGCAAGTACTCAAATAAGTCTTGCCT | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | AATTATATTTAAAGTAAGTATCCTGCTTAAGTGAGAGAAATTCTTGGCAGATCTTACCTC TAGTACTATTGTTTAGTGCCAGGATGGAAGGTGAGTCTCTGAATTAGACTTTTTGCTGAA AGAACGCTCCCAGCTGGGCATGCT | 1422 |
| FOXN3 | ADXCRPD.8765.C1_at | TCTTGAAGAAGGTACTGCCCGGCCAGATGGGTGGACCTGATGTGCTTTGATATGCCTGAG GACAGGTGGGAGGTGTATTGAACACGTGTGGGTGTGGGTGATAAGGTGTCTTTTTCAAAG CCTGAATTAGATTTTGTCTATACTCTGGGTCTATGCACCACAACGACCCTTTCCAATAC TCTGACTCCTCTCTTTGTCCACTTTCTTAAAACACTTATTCAATGATAAATTGTGTCTCA CTGAGTTTTTCCACCCAGTAGGTGCATTTGCAAAAT | SEQ ID NO: 1423 |
| PTPRK | ADXCRPD.11104.C1_at | GGCAGTGGATAATCGTCCGGCCTTCCCCTTCCTCGCATTCCTCCTGCCACTTTTCCACCT GAAGTATCAGTTTCAAGAATGACCTTTTGGAACCAGGCACTTCTCGATGAGAAGCCCATC CTAGGTACTGAAACTGTTGCACCATCAGATAACCTTCCTGTGGTCTTGTTAGATTGCATA TCCTAAAAATCCGGTTGATCACATCACAGTCCATTGAACAAGACATACATTCCACTTGGA TGGGGCCATATCGTAGCATCCCTTCCTCTGGCCAGTACTGAGGGCAGCCCTG | SEQ ID NO: 1425 |
| ARID5B | ADXCRPD.11117.C1_at | GATATTCACAAATCCCTTCACAAGGCCCACGTGCGAAGTAATGATCTGGAGGTGCCTGG GCATCTGTGTTGGAAGGGAGTCAAGACTCACCAGCCAGTCAGTTTGTGGGCTAGAGTTGT CCCACAAAAATCAGGCATGTTCACCTCCCCTCTGGGCCCCTACAGCTGGGACTGATCATA GCCTCAGATTAGAAGAAATACTGACTTCTAACTCTATAAGCCAGCACTCCTGGGTAAGGA GTGAAGCTCTGTTGGCCATGCC | SEQ ID NO: 1427 |
| KDELR3 | ADXCRPD.11126.C1_at | AGAGGAGGGACATTGTTCCAGATTGGGGTTGACTTGCCCATCATGAGTCTTGCCCTCAGG CCTTGGAGAACAATCATTTATGTTTTTTATTTCGTCGGTAAGACACCTTAAGGTTTCTTG TTGCAGTGAGGCACCATCTTTGTGCAGTTGGCCGAGGTTTTTTATGACCTTACAATGGGT CTTTAAGGGCGATCTATTGATGA | SEQ ID NO: 1428 |
| ELF4 | ADXCRPD.11148.C1_at | AGGCCTCCCAGAGAGTAACTTGGAGGTTCCATTTGCTATTGACTGGATTGTGTTTGCTTG AGGAGCCTGTGACCACCCGCAGGGACAGGCAGCCTAGGATAAACTGGACCACCCCTGAGT AAAGCACTCCACTCAGTCCCTTGGTCCCCACCCCTCAGTTAGAACTGCTAGGCTTTGGGG GATGGGAGGGTGGCAATTATTCTTAACCTCCCGAAATTCCTGATGACCCGATAACAAGGA GGTATTTAGACATAGAATGAGGAGCTAATCTTTTTCCTA | SEQ ID NO: 1430 |
| VCAN | ADXCRPD.2145.C1_at | AGGAATGACTCTAGCTACAATAATACACAGTATGTTTAAGCAGGTTCCCTTGGTTGTTGC ATTAAATGTAATCCACCTTTAGGTATTTTAGAGCACAGAACAACACTGTGTTGATCTAGT AGGTTTCTATTTTTCCTTTCTCTTTACAATGCACATAATACTTTCCTGTATTTATATCAT AACGTGT | SEQ ID NO: 1431 |
| VCAN | ADXCRPD.2145.C1_x_at | GGAATGACTCTAGCTACAATAATACACAGTATGTTTAAGCAGGTTCCCTTGGTTGTTGCA TTAAATGTAATCCACCTTTAGGTATTTTAGAGCACAGAACAACACTGTGTTGATCTAGTA GGTTTCTATTTTTCCTTTCTCTTTACAATGCACATAATACTTTCCTGTATTTATATCATA ACGTGTATAGTGTAAAATGTAATGACTTTTTTTGTGAATGAAAATCTAAAATCTTTGTA ACTTTTTATATCTGCTTTTGT | SEQ ID NO: 1432 |
| CETN2 | ADXCRPD.2161.C1_at | TAAACCGCCGCTTATTTACGCCACAGCGCGCCGTCACACTGTATCTATATTTTGTATTCC CCCCGTCGCGACTCGTATCTTATCATACCCAAAATTANCGCGCCCGCCCCAGCAGCTAGA CACAACCACGACATCGTATATATGGGGCGCTATATTAGTGACATNCTAACAGCTCGCGAG TTCGGTGCGTCGCCGCCGGGAAG | SEQ ID NO: 1434 |
| KDELR2 | ADXCRPD.1509.C1_at | AGAGCTGTGCTGACTATGTTACATCCTAAAAAAACTATATAAAGCAATGGATAATGTCGT TTATGAATTAAGGTGGGAAAATCGGGTTGGAATTGTGTCAATGGACAAAGGCCGGAGGGG CGAAATTAAGTCACTACTCTGACACCTCGGATTTGGGAGAAAATATGCCGCTGCAATAGA TGGTATTGGAGGAAAAGATGTTTGTGAACAATAAGGGATACGGAAAGATAGCGCCAACAT CAGGAGCAACGTG | SEQ ID NO: 1435 |
| LPP | ADXCRPD.11183.C1_at | GAATGACCAACAATTTGGCTTTCCTAGAAAGAGAAGAGAATATCTGAATTCCCTGTAAAC TGGTAAATCCTCTACCATCAGTCCTGAATTCTGAGGGGGCCTGATATTTAAGCAACAAAA CTTAGAAGGTTCCACCTGTTATTCCTAGCTCTGTCACTAAAAATCGTGTCCAAACAGAGG TAATACGAATGTGTTACCCGTTCCCGAAATTNNNNNNNNNNNNNNNNNNNNNNNNNNNNN NNNNNCCCAGAGCACAGAATGGATCCAGTGTAGTAGTGCAGGTGACCA | SEQ ID NO: 1437 |
| LEPROT | ADXCRPD.1565.C1_at | TTGCCTGCCAACACAAGGCCGCAGTCCCCATTTGATCACAGCCACACGAGCAAGAATAAC AGGAAATCCAAAGGCAGAAACAACAATTCCAGTAGTGAAGAAAATATGCCAGTTCCCGACA GGCACTACTGGTTGCATCTGAGTCATAGGTGACTCTTTTGGCAATGAAATGGGGGATGGG GGAGATGCGTGGAAAATCAGGACGAATAAGGGCCAGTAAACGCCATAATCCTCTAAGGC ACATCCCAGCATAAGAAAGTCAGTCCAATAGCCCCACTGAAGGATAATGGCCCGA | SEQ ID NO: 1442 |
| CYR61 | ADXCRPD.10589.C1_at | GGAACCGCATCTTCACAGTCCTGGTCAGCTGGGCGTGCAGCATCGGCCGTCACGCAGG AACCGCAGTACTTGGGCCGGATATTCTTCACACTCAAACATCCAGCGTAAGTAAACCTGA CTGGGTTCGGGGATATCTTGGTACTTGCTGCATTTCTTGCCCTTCTGTAAGAGAAAGGC GAGAAGGCAAGTTAGGGGTGATATTTCTCTTTCTTCAAAAAGATGTTCACATCCCAACCA CCTGCCAGGCAACAGTCTACACGTCCCTTAAGGAACTTACTTTCAGGCTGCTGT | SEQ ID NO: 1443 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| CDC14B | ADXCRPD.9445.C1_at | AATATCGAATAGTGCAAATTGTATAATTACAA | SEQ ID NO: 1447 |
| CDC14B | ADXCRPD.9445.C1_s_at | ACAGCGTATATTTCTAATCATATTTTTTAAAGCCAAGAGAACTGGTTGAATGAATGTTTATTTTCCTGAAGGTATTTTAAGATAAAGCTTCCTAATGGCGTGTAAACTTTGCATA | SEQ ID NO: 1448 |
| EPAS1 | ADXCRPD.17826.C1_at | CAGTGTAGCCAGTGTGCTCGGCGTCTGAACGTCTCAAAGTGGCCACAGCTGACAATGACAGCTGACAAGGGAGAAGAAAAGGAGTAGCTCGGAGAGGAGGAAGGAGAAGTCCCGGGATGCTGCGCGGTGCCGGCGGAGCAAGGAGACGGAGGTGTTCTATGAGCTGGCCCATGAGCTGCC | SEQ ID NO: 1450 |
| EPAS1 | ADXCRPD.17826.C1_x_at | CAGTGTAGCCAGTGTGCTCGGCGTCTGAACGTCTCAAAGTGGCCACAGCTGACAATGACAGCTGACAAGGGAGAAGAAAAGGAGTAGCTCGGAGAGGAGGAAGGAGAAGTCCCGGGATGCTGCGCGGTGCCGGCGGAGCAAGGAGACGGAGGTGTTCTATGAGCTGGCCCATGAGCTGCCTCTGCCCCACAGTGTGAGCTCCCATCTGGACATAGTG | SEQ ID NO: 1451 |
| POFUT2 | ADXCRPD.9474.C1_at | TGAGGAGGGACAGACAGCTCTTCCTTTCGGAGCCTGGCTAGTCTAGGACATCACCTTGCTGTGTCTTCTCAAGCTTTTAAAATTGACCCTGAACGTGTGACAGGGTCCTATGGTGTTACTCAAAGCTGTGCAGGGTAAATGATGACATATTTATTCTTTTTCCATTTGTTCTAGAAACAGTGCCTTTTTCATCAGTTGCATTTTCCAGGCTGAGAGCTGTATAAAACATTTTGGACTGTGACCATGTACCTTCCTTTTTAA | SEQ ID NO: 1452 |
| COL6A1 | ADXCRPD.17873.C1_at | TGTGAATGCAAGTGCGGCCCATCGACCTCCTGTTCGTGCTGGACAGCTCAGAGAGCATTGGCTGCAGAACTTCGAGATTGCCAAGGACTTCGTCGTCAAGGTCATCGACCGGCTGAGCCGGCGACGAAGCTGGCTCAAGCTCGAGCCAGGCCAAGTCGTACGCGGGCTGTAGCTGCAGTACAGCCACAGCCAAGATGCAGGAGCATGTGAGCCTGCGGCAGCCCCA | SEQ ID NO: 1454 |
| YPEL5 | ADXCRPD.11244.C1_s_at | GAAAACTGTACTTTGTACCCTCACATACAAAGGGATCAAATTTGACCTGGTGTTATTTTAGCCCCAAATTTATGACATTACACAATATTAAAATGTAAATGTTTCTTTACCCAAACTACTTCTAGATATTCTAGTATTTGCTTCTGGTGGAATTAAATGACGGTAAAATTGGCTAATTATTTGAATGAATGAATGGATGGATGTTTTGCATGCTCACTTTCTAGGTCCTTTGTCTAGAAAGGA | SEQ ID NO: 1457 |
| RBPMS | ADXCRPD.10645.C1_at | GCGAGGTTGAGCTGTCATGAACTCTGGAGATGTGTCAACTGACAACACCAGACTGACTTTGGCTTTGACGAAGTCTGAATAGAATTGGTTCCAAATGCCCACTGCCTCCGTCTCCTGTGGGGTGTGGCAGGACGTCTCACAGTGAGCACACGCCATTTGGGAGCTCATGGTATGTGGTCGGTTTG | SEQ ID NO: 1462 |
| MALT1 | ADXCRPD.2292.C1_at | ATTATTTTAATCATCTTCAGTGCACTCCACTGGCTCAATCGTCCTTCCAAGGATGATTTCAAACCTCCTGGCAAACTGGAACGGGAGA | SEQ ID NO: 1463 |
| SLC20A1 | ADXCRPD.10696.C1_at | TATTATCATTGAACTTCGGTAAAGCATTAATTGTGGCATCTTTGTCAGATGTTTAGATAAGATGGTTGCCGTACGCATAGTCTGCATGTTGTATTTTTAGTCTTTGAAGATATGAAGTCAGGTAAGCAACATCCTAACATAGTCTATTTCTTGACATCTCTTACAAACGTAGAGTATAGCCTATCCTCAGGTGTGTGCTGAAGTTTATATTAGGGCTTTTGGGTACCTTAGAATGTGGGTATTGCAGTCTTTATTCAGGATGTTATCAGTCACTGGTACAGTTAGTCTTGTTAT | SEQ ID NO: 1465 |
| MDFIC | ADXCRPD.1686.C1_s_at | TTTATGTTCATAGTACTTTTCCTCTTGTCTACTCCAGACAGTTATTCCATAAAGCATTTGTATAATTAAAAGGAAAACAGAAAAAGGAAAAGTAGGCAAATGTGAAAATAGTTTCAATATATCTTATGATTTCTTAATGTAAAATGTTTTGTTGAAGTATATGGCTATCATGACTAAGTGCTAGAATTTATAGTTACAGGCGGTGTCCTTTTAAATGTGGAAAGGCTTTTAAAATATTTTAAAACTGGACCTGTATTATCCTGAATACACT | SEQ ID NO: 1466 |
| SYNJ2 | ADXCRPD.17920.C1_at | TGAGAGCCGAGTGACCGTTCCTGCAAAAGTTTACCCAGGCCAATT | SEQ ID NO: 1467 |
| SYNJ2 | ADXCRPD.17920.C1_s_at | GAATATCCCCTTCTGACTCATAGTCCAAACTTGTGAAGTCAAAGTTTTCCTCCAGCAAACAGGAGTTGGCAGTGGGAGACACGGGGGCCATGCTGTCTCGTTTCCGAATGATCTCCTCTCGCAAACCTTTCAGCCAGTCCTTGGTCTTCGGTCTAATCTTCACTGCTCTGCCTTTCACCTTCATACCGTCCACGTCCAGGACACTGAGAGCCGA | SEQ ID NO: 1468 |
| POFUT2 | ADXCRPD.17928.C1_s_at | TTCATCAGCCATGGCGGCTGGCAACGCCGAGGACAGAGCGCCAGCTCTAGAGGCGTGGGGCCTCATTCTGGGCCTGGGACCCTGCGAGGGACGGTCACATGTCCAGCCCAGCTCCCGGCTGGCAGTAGACGGTGACTCCACGGCGACAGAACCTGCATCCACCCGCGCCTGTCGGGTCCGGGGAGCGGCCCTGGAGGATCACTCCTCAGTAGGTGATCTTCCAGTGGGTGGGTTGCTCACACGCCTTCTCTT | SEQ ID NO: 1469 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| VCAN | ADXCRPD.8962.C1_s_at | GATTCATTTCACACTTCTGCAACTACTCAGGCAACCAGACAAGAAAGCAGCACCACATTT GTTTCTGATGGGTCCCTGGAAAAACATCCTGAGGTGCCAAGCGCTAAAGCTGTTACTGCT GATGGATTCCCAACAGTTTCAGTGATGCTGCCTCTTCATTACAGAGCAGAACAAAAGCTC CCCTGATCCAACTAGCACACTCTCAAATACAGTGTCATATGAGAGGTCCACAGACGGTAG TTTCCAAGACCGTTTCAGGGAATTCGAG | SEQ ID NO: 1471 |
| RND3 | ADXCRPD.11316.C1_at | TTCCACAAACTATGTCATCAGGCTCATTTTTCAAAACCAATGTGCACAACACCTGGTCAA ACTTCTGCGTCAACTACATTCCGTGTCAATAAAATGTTTGCTTTGCCAAGGGAGACTCTG AGAAAGTGACCAATATGTAGCAACTGAGAAGTCATTTAAAGGACATCAGA | SEQ ID NO: 1472 |
| PLOD2 | ADXCRPD.2305.C1_s_at | TGAAGGACTTCCTGTTAAAAATGGAACAAGATACATTGCAGTGTCATTTATAGATCCCTA AGTTATTTACTTTTCATTGAATTGAAATTTATTTTGGATGAATGACTGGCATGAACACGT CTTTGAAGTTGTGGCTGAGAAGATGAGAGGAATATTTAAATAACATCAACAGAACAACTT CACTTTGGGCAAACATTTGAAAAACTTTTTATAAAAAATTGTTTGATATTTCTTAATGT CTGCTCTGAGCCTTAAAACACAGATT | SEQ ID NO: 1473 |
| CORO1C | ADXCRPD.11328.C1_at | CAAGCAATTGCAAAAACTCTTTTACCACCTGTGACAATATCCCATTTTATCTGCATAAC TTTGGCATCTTACGTCACTGTCTTGTACAGTCTATGCCAACAGTTTCAGTTTTTTCTCTC CTTTTGGGGCGAGGGGAAATTTCATGTGGTCAAATGGCATTACAAAATTACTGAAAAGTC ACTTTACTTTCCCTAAAATCTTCCAACAGAGAACATGTCAACTGTCAATAAGCACATACA C | SEQ ID NO: 1475 |
| CNN3 | ADXCRPD.2332.C1_at | CATATCAAATGGTTTCTAACAGGTATTGGTTTGCCTAATTTTCAAAACAAACCTCCTTGA TCCACGGGGCCCTTTTGATGAATTACAATGGGGGAACCTCCATTTCCCTTTACCCGAC GGCGGAACACCACAATTCTTTTTTCCCCAAGCGGGGTTGCTCTCTCTTTACCAAGCAATC CTTTGGTTACCCAATCACCGTGTGCGCCTTGTGTGGTAACACTTTTTCAACGCGCCCTCA TGCGGAGACGAAATCGCACTCTCTTTGCG | SEQ ID NO: 1476 |
| ARID5B | ADXCRPD.2347.C1_s_at | AAATCTTAAAGGCAGACCACGCAAAAAGAAACCATGCCCACAAAGAAGAGATTCATTCAG TGGTGTTAAGGATTCCAACAACAATTCCGATGGCAAAGCCGTTGCCAAGGTGAAATGTGA GGCCAGGTCAGCCTTGACCAAGCCGAAGAATAACCATAACTGTAAAAAAGTCTCAAATGA AGAAAAACCAAAGGTTGCCATTGGTGAAGAGTGCAGGGCAGATGAACAAGCCTTCTTGG | SEQ ID NO: 1477 |
| PTRF | ADXCRPD.10702.C1_s_at | GACAGAGCAGAATGAGCCCTCACCCTGGCTGGGGGTCCAGCACAGGCTGTATCTGCAGAG GGTCCCAGAGGAACGCTGGAGCCAAGAGAAGCCCTGGGAAGGAGGGGTGGGGAACGACAT GCATGTGAGGGATGGCACACTGATGTGTTTATGCACCTGCACACAGGAGCGCATGGCCAT GGCTT | SEQ ID NO: 1478 |
| SYNJ2 | ADXCRPD.1723.C1_s_at | GAAATCTACAAAATCACTGCCACTGACTTTTACCCTCTTCAGGAAGAGGGCCAAGGAGGA GGAACAGCCTCATAGCTTTGAAGAAAATCCTCAGCTCGGGGGTGTTCTATTTCTCATGGCC AAACGATGGGTCTCGCTTTGACCTGACTGTCCGCACGCAGAAG | SEQ ID NO: 1482 |
| CTNNAL1 | ADXCRPD.129.C1_at | GACAGACACACTGGGAGTCGTGCTGCGCACCCCCCCTATTATTTTCGCGCACCCAATTTA AAGAGGTGGGCCGGCCGCGCCCACCCGTCCATCACCTCGATATGCACATACCTCCGCCG TCGGGGCCCTCGCGGCCCGCCATGCTGTTCGCAAACACTCACCGCCCGGCCGCGGGTCCG CGATGCTGCGCGTGTGTGAGAAGTATGGTGAGCGCGATATGGCGGCAACACCACTGTCGA CTTGTCTCG | SEQ ID NO: 1484 |
| RABAC1 | ADXCRPD.9642.C1_at | AACCCGTGTGAGGTGTCTTCTGGGACCTGCCGGCCTCCCGGGCCAGCTGCCCCACCCCTG CCCATGCCTGTCCTGCACGGCTCTGCTGCTCGGGCCCACAGCGCCGTCCCATCACAAGCC CGGGGAGGGATCCCGCCTTTGAAAATAAAGCTGTTATGGGTGTCATTCAGGAAAA | SEQ ID NO: 1485 |
| RABAC1 | ADXCRPD.9642.C1_x_at | GAGGAGCTGCAGATGGAACCCGTGTGAGGTGTCTTCTGGGACCTGCCGGCCTCCCGGGCC AGCTGCCCCACCCCTGCCCATGCCTGTCCTGCACGGCTCTGCTGCTCGGGCCCACAGCGC CGTCCCATCACAAGCCCGGGGAGGGATCCCGCCTTTGAAAATAAAGCTGTTATGGGTGTC ATTCAGGAAAA | SEQ ID NO: 1486 |
| GALNT2 | ADXCRPD.12003.C1_at | CTAGTGCTGTCATGTTGGAGGTGTCTGACCTTTGCACTAAGTTTCCCCACTTACACTAAA TGGGGATAANNNNNNNNNNNNNNNNNNNNNNNNNNNNNNNNNNNNNNNNNNNNNNNNNNN NNNNNNNNNNNNNNNNNNNNNNTAATGCAGAACTACTCACTGCTGCTGGAGTGCGCTGTTA TATTCTTTATTAGGTCCTCAGACTTTTTCTATGCCTAAGCTTGAGGGTCTCTCTCAGCTG TGTTTTTC | SEQ ID NO: 1487 |
| EPAS1 | ADXCRPD.3002.C1_at | ACCTTGTGGGCAGACGACAGGCTGTAGTCCTGGTACTGGGTGGCGTAGCACAGTGGCGGG AACCTGCTCTTGCTGTTCTCCCCGGAACTGATGGCAGATGGAGGCTGTGGCACCGGCAGA TGTCTCAGGGGATGCCCAGGCCCCTCATGGGGTATCGGGTGAACTTATCATTGGGTACA TTTGCGCTCAGTGGCTTGTCCGGCATCAAAGGGCAGCTCCCACGCCTGAGGTTCTTCATC CGTTTCCACATCAAATGTGAGGTGCTGCCACCAAGTTGGGTCTCCCGCATACGCAA | SEQ ID NO: 1488 |
| SVIL | ADXCRPD.12020.C1_s_at | GCTTCTGGGTGGCCAAACCAGTTACCCAATCTGCTGGAGACCCAAAAGAAGATGAACTCT ATGAAGCAGCCATAATAGAAACTAACTGCATTTACCGTCTCATGGATGACAAACTTGTTC CTGATGACGACTACTGGGGGAAAATTCCGAAGTGCTCCCTTCTGCAACCCAAAGAGGTAC TGGTGTATGATTTTGGTAGTGAAGTTTACGTATGGCATGGGAAAGAAGTCACATTAGCAC AACGAAA | SEQ ID NO: 1489 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FLNA | ADXCRPD.3034.C1_at | AGTACAATGAACAGCACGTCCCAGGCAGCCCCTTCACTGCTCGGGTCACAGGTGACGACT CCATGCGTATGTCCCACCTAAAGGTCGGCTCTGCTGCCGACATCCCCATCAACATCTCAG AGACGGATCTCAGCCTGCTCGTACGGCCACTGTGGTCCCGCCCTCGGGCCGCGAGGAGCC CTGTCTGCTGAAGCGGCTGCGCAATGGCCACGTGCGCATTGCATTCGTGCCCAAGGAG | SEQ ID NO: 1490 |
| PLAU | ADXCRPD.12085.C1_s_at | AGAATTCACCACCATCGAGAACCAGCCCTGGTTTGCGGCCATCTACAGGAGGCACCGGGG GGGCTCTGTCACCTACGTGTGTGGAGGCAGCCTCATCAGCCCTTGCTGGGTGATCAGCGC CACACACTGCTTCATTGATTACCCAAAGAAGGAGGACTACATCGTCTACCTGGGTCGCTC AAGGCTTAACTCCAACACGCAAGGGGAGATGAAGTTTGAGGTGGAAAACCTCATCCTACA CA | SEQ ID NO: 1491 |
| RAB31 | ADXCRPD.2471.C1_at | GGTTGTAAAGCCTCATTGTAGACAAGGCCTGAGCATCCACAGAGAAGATACAATGTTTAT ATGAATCCTGGTGTGCCCAAGTGTGATCTACTCTCTTCACTGACTACTCTGAGTGCTGAT GAGAATATATATATTATCCTCTGACTGGCTTGAATAGCTAAGACAATACAGAAAGGTAAC AGAGTGGTTTCACACCCTCATGTGCTTCTGAAATAAAACCATGGGCTCATTAGTGGGTAG CTCACTATCTGTGGCAA | SEQ ID NO: 1496 |
| ATP2B4 | ADXCRPD.11491.C1_at | TTCATTTTTCTTCCCCTCTGCTAGTTTGGAAGTTATATTATACCAAGTTTTTTAGTATTA GCCTAGAAATCTTAACATAAAGACTTCTAATAAGCAATATCTTTAATTTTTTTNCCTAC CCAATACTAGATCATGAGCATTTTCCCACATCATAAAGAATTGGTCACAAGTCAGCCCCA AACATAGTCCAGTGGAATCCAATGATA | SEQ ID NO: 1498 |
| ALCAM | ADXCRPD.1829.C1_at | AATCCTGGGAAAGAAATCGCTGTGCAGTGTTCTCCCAGAAACCAGGCTTCTGCTTGAAAG AGCAAAGTTTAAAAGTCTAGTCACAAGTAGCCCATATCTGGTCTACTTCAAAAAGTTTCC ATTTATACTACCACCTTAAAAATTTCCTCAAGCATAAAACATGTTTATAAAGTTACAAAT TTGAATGTAACTAAAGATACATAGACATTTTATTATTACACTTTCATGTACTGCTTGATA A | SEQ ID NO: 1499 |
| ARID5B | ADXCRPD.10890.C1_at | GACACACCAACACAGTGAAATACAGTACTTGAGAATTCATGCACCAGGTCAGAAAGTTGT AAAGTTAACATCGAGTTTTAACAAACCCTTCTGTATATGCCCTGATAAACAAGTGAACTT AAGAGCTTCTAGCTAGTAAATAAATAAGTCAGTCCTGTGGCAAATATTACAAGTGTTGAA TCACTTACTAGAAGAATACTTAATTCCGAAACTCGGTTGGGCTGGTTTTATTTTTTTATC ATGTGGAGTTGCCAAACATTAAACCAGAA | SEQ ID NO: 1503 |
| TPM4 | ADXCRPD.295.C1_at | GTGTGGGGGCTGACTAAAGTTTACAATTCCAACTAAAAATCACCCTGCTTCTGGCTTATC TGAATCCCTTACCCACCCCACCCCACCACCCTACTCCTATTTATTCAGCACCACACTACC CAGGAAATACACTAGCAAATTGTGCAATGGAATAAAATCCACACTTTAGATTCTTGCAAC TGTATCATATGTAATAGTATCACTTTTTCTACATTTTGGCGCAAATAAATTTTTACATAA ACTACGGGAGGCCAAGGGAGCTCGATATAAAAACATGT | SEQ ID NO: 1505 |
| NFIB | ADXCRPD.9768.C1_s_at | TCCATGTCACAAGGGTAAAGCTTACAGTTTACAAACTGGGAACGCCAGGGTGTAGGATAT AAAAACGCACTCTTGAGAAAACAAATGTAATCAGGGTGCTGAAAACTTGCATGGTGCTTT CAGACATTAGCCTTGTTCAACAAATTTCTTGTATTGACAGATCCATAGTGTGCATGGGCA GACACATTTTGCCTCTATGTCTCTTAAAATTTTAATTAAAAATACTCTTTCCAGTAATCC TAATTTGCACGAAGATATAATGTCCACATTACGTGCCTTGC | SEQ ID NO: 1507 |
| EHD2 | ADXCRPD.3133.C1_at | TGGTACAAGAGACAATCCCGGCATTGGACATGGAGTTCGGGCTGATCTGTCCTACCTGAA CACCGCTTCCGTTCCTGGGCTGTCGTCTTCACCGCCTGGTTTTCCATGGAAAGGAAGCCT CCCCAGTGGCCTTTTGAAAAGGCACTGTGGCGTGGTCCGATAAGTCTCTGCAGAGGCACC AGGGATGCTTTCAGGACACAGCACCCAGAACGGAGGCTCGATGGTTTAAAGTTTGGCTCT GCATACACCTTAGGGTCGCTGACACAATATCTGGACACGACGTCAGACATGATAT | SEQ ID NO: 1510 |
| FOXN3 | ADXCRPD.12156.C1_at | CCGAGCTGACGAGTCATAGATGCATAATTGCAAGATATAACCAGTAGGAGAGAGAGAATA CACAAGGAGTATAACCACCATCGGCGGTGCTCTCTCAAAAGGA | SEQ ID NO: 1511 |
| FOXN3 | ADXCRPD.12156.C1_s_at | AAGGTGCAGCACCATAGACACATCGGTTTCGGCTGTTAAAAGATGGATCGTTTTAAAAAC TGTGTTTTCCTTCCTTAATTTTTGGTCAGTGAAGCTAGCACTTGTTTGCTGAACTGTGGA AGAACTGCAAGGTCACACACATTATTCATGATAAAGCAACCGAGCTGACGAGTC | SEQ ID NO: 1512 |
| P4HA1 | ADXCRPD.11500.C1_at | AACCCAGACTACAAGGCAATATAAAACTTTTTTTCAATAGTCTTTTGCACTAATTTTTTT GGCATAATTAAAAGTTGTACACATTTTTCAACTGTTTTACCATCTAAGTTACCAAAACAC AAAATGGCCAATGTAATTATCCGCCTACCAAAGTCCTGATTTTCAGTACTTCAAAATAAA ACTCATTTCAAAATGTCAATAAAAACAGCACTACCCATTTAAAAGAGACAGAAATAGTCC TTTTCCTAGTTAGTCTATGTAAATCTAAGAAACATTTGTCATCAGCTATCAAAA | SEQ ID NO: 1513 |
| AHNAK | ADXCRPD.3149.C1_at | GATGGTCAGCCCGTGGGAGCCACTACCCTGCCAGTTGGGCAGCAGCAGCTCCCGGGTTGT CTCCTCCTTCTCCATCTTTGCAGGATTCCGCTCAGGAGCGAATGCCTTGCCAGGAGCCCG CCCCTCCTTCCTCTCTTCCCCTCAGTCTCTCTCGTCGGGAATCTCGGTCACAACCTGAGG GCTCAGCCCCAGGGCACGGCCATAGCCGGCGCGAGGCCCAAGGCTGCGGTGCTGCGGCTA CTGGCGGCGACGAGCCCCGTTCCGGGCGGGTCTGGCAGAGAGG | SEQ ID NO: 1515 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| LAMB1 | ADXCRPD.12165.C1_at | TGAAAAGCATACACCCAAGTTTTACTTTTGAAATCCTAAGGTCTTGGTTTTGAAAACCCC AGGCGCTAAGGAAATTACATGTTTTAAAATCCTAAAGGTTGGGGAATTAATATTCTAAAC TTCAAATTTGTGAATAATCATGACGTTATGGGCAAATACATATAAATAAACATATAACCA GAACACGTCTTTCCCCTTTATCCAATGGAAATACGATCAAGCATCACTCTTAGCAGAAGA TACCAGACACTTGTAGGGACACGAAAAGCGATAT | SEQ ID NO: 1516 |
| AMOTL2 | ADXCRPD.2508.C1_at | TTGGGAACCACTTCGGGTGTTGCGATAACACCCCTCCACCCACGTGGGGCATAACCCTGG GGCTACATGCCAACCCCAGTGGAAACACTTCTCGAACGTTTCCGGGGAGACACATTACA TCAGAGAAAGCCCCTACTGTCGCGGTGTGAGG | SEQ ID NO: 1517 |
| AMOTL2 | ADXCRPD.2508.C1_x_at | CGGAGCTCCCCGAAGTGGCGTTTTGGGAACCACTTCGGGTGTTGCGATAACACCCCTCCA CCCACGTGGGGCATAACCCTGGGGCTACATGCCAACCCCAGTGGAAACACTTCTCGAAC GTTTCCGGGGAGACACATTACATCAGAGAAAGCCCCTACTGTCGCGGTGTGAGGGCCCCC CCCACCGTAAAAATCTTTTTGGTGGGGCGTGGTGGGACCTCTATAATCA | SEQ ID NO: 1518 |
| YES1 | ADXCRPD.12191.C1_at | CTGATTATCAGGTTTTGGCTGGGTTTTGTTAACTGCTGAGCTCTTTGAACAAATAAAATA TTTGGNCTACAAGTGCTCTGATTATGAGGTGGGTGAACCTGTAGCCTTGCCAGTCACCCT CCTTTACCACCTTAACAGGTCCTCACTATTTAAAAATCACTGTTTTGAGTTCCCTGTTAG GAGACTCAGATTCTCCCAATAAGGCATTGCTAT | SEQ ID NO: 1519 |
| TFE3 | ADXCRPD.2523.C1_s_at | TTATTGCTCCGCATACTGAGAATCTAGGCCACCCCAACCTCTGTTCCCCACCCAGTTCTT CATTTGGAGGAATCACCCCA | SEQ ID NO: 1520 |
| CAPN2 | ADXCRPD.2526.C1_at | GGCACGAGAATGTACTCTCCTGGCGGCAGCTTGAAGCGGTTGAGCACCTCCCGGAGGTTG ATGAAGGTGTCTGAGCGCTCCCTGGCGCGATTCGTCAGGAAGAAGTTTTTGCTGAGGTGG ATGTTGGTCTGCCCACTTAACTCCTCTGGAACCTCATAGATGCCAAAGCCGATGGTGTGC ATGTCCTCGCCCATCTTCCTCTGCCGCCGTCGGTGCTTCTGAATGAG | SEQ ID NO: 1521 |
| ADAM9 | ADXCRPD.11545.C1_at | CTCCGCACTGCAACTGCTAAAGTTTCTGGAACACGATGCTCCTGAATTCATGATGCAGCT CTTTGCTCCACAGGAACAATCTCTCCCATCATCGTGATTCATTCCAAGATTATGACCCAA TTCATGAGCAACAATGGAAGCAAATGTCTCCACAGTGATTTGTCCAAACACATTAATCCC GCCTGCGTGGCTCCTTGAACACACTGTTCCCACAAATGCCATTCCTGCAGTTCCACCCCG ACCTTTCTTTAGAACTAGCTGTGTACTGTCA | SEQ ID NO: 1522 |
| PTPRK | ADXCRPD.10919.C1_at | CATAATAGTTCCAAGCTAAAACAACCCAAATGTCTGTCAGCAGTGCAATGTATAAATAA ATGGTGGCATATTCATAAAGTGAAATATTGTACTGCAAATAAATGAAAGAACCATTGCTT TATACAATAACATGAATGAATTTCGCAAACACAATCTTAAGGGAGAGAAACCAGATGCAA GAGAGTATGTATATATACATTTATATAAATTATGTAAGTTTCAGAAACAGGCAAAACTAA TCAATGATATTAGAAATCAGCATATTATTTACTTGAAGAGGATTTGGGCAACTT | SEQ ID NO: 1525 |
| CD44 | ADXCRPD.11577.C1_s_at | AAACAGCATTGCTTTCTGAAATTAGGGCCCAATTAATAATCAGCAAGAATTTGATCGTTC CAGTTCCCACTTGGAGGCCTTTCATCCCTCGGGTGTGCTATGGATGGCTTCTAACAAAAA CTACACATATGTATTCCTGATCGCCAACCTTT | SEQ ID NO: 1527 |
| SPTBN1 | ADXCRPD.1922.C1_at | TCATATAGCATCTTGGTTAGTTTTTCCTTATCTCTATGTACATATCTATCTACTTCTGAC TGTAGATGGGTATATAGATAGATGCCAAAGCTTCTTATGGTTCTGGGGGTAGTATGCATC ATTTATTGGGGTCTCTGCCTTTAA | SEQ ID NO: 1532 |
| SPTBN1 | ADXCRPD.1922.C1_s_at | GTCAGGATAACGTCATATAGCATCTTGGTTAGTTTTTCCTTATCTCTATGTACATATCTA TCTACTTCTGACTGTAGATGGGTATATAGATAGATGCCAAAGCTTCTTATGGTTCTGGGG GTAGTATGCATCATTTATTGGGGTCTCTGCCTTTAAACACATCAAAATTCATTTTAGACA | SEQ ID NO: 1533 |
| RAB31 | ADXCRPD.1938.C1_s_at | AGCCGCCGGTGCTGTTGACCCAAGGGCCGTGGTCCACGGTACTTGAAGAAGCCAGAGCCC ACATCCTGTGCACTGCTGAAGGACCCTACGCTCGGTGGCCTGGCACCTCACTTTGAGAAG AGTGAGCACACTGGCTTTGCATCCTGGAAGACCTGCAGGGGCGGGGCAGGAAATGTACC TGAAAAGGATTTTAGAAAACCCTGGGAAAACCCACCACACCACCACAAAATGGCCTTTAG TGTATGAAATGCACATGGA | SEQ ID NO: 1535 |
| MAPK1 | ADXCRPD.10998.C1_at | GAGATATCCGTAGATGGTTTATAGAAATGCATTTGACTTTGGTAAACTGATGAATTACTG GAATAAAAAGATGTCCAACAAACTCTTATTCCAGTAATCCCTCTTTAAATTTTTTAAGGA CAAACATATCATCTGAAAATCATGATATTTTGTTTCTTTTCATGACGTAGATATATTTTA TCTTGTCTTAACTGTGCTGGCCGGACTCTCCATTACAAAGTTGAAGAGCAGTGGTGATAC AGAGGGCATCCCTGACTTGTTCTGATGTTAAAAGGAAAGCTTTTATTGAGTGATAG | SEQ ID NO: 1537 |
| AHNAK | ADXCRPD.9802.C1_at | AACATCAAGGCTCCCAAGATCTCGATGCCTGACGTGGATGTGAACCTGAAGGCCCAAGGT GAAGGGTGATGTGGATGTTTCACTACCTAAGGTGGAAGGTGATATGAAAGTGCCAGAGGT AGACATTAAAGGTCCTGAAGGGAAGCTCAAAGGTCCCAAGTTTAAGATGCCTGATGTACA TTTCAAAAGCCCACAAAGGCTAAGGTCCACATCTGGATGTGA | SEQ ID NO: 1539 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FLNA | ADXCRPD.3227.C1_at | TTCACCCTGTCTGGGTGGAAGTCCTGGGGCGCGTCACGGATGTCAGCCATGAAGGGGCTG AGGCGGATGTCTTCGCTGTTGCACAGCAGGTGAACGGCATACTCGCCAGCCTCCTGCGGC CAGTAGCGCACATCACAGGAGCCGTCGCCCTTGTCGTCACATTCGATCTTAGCCTGCGAT GGCCCTTCCACCGAGAAGCCCAGCGTGCCCACGTCGTCCCCGATAGCCTCCACCACAAAG TCTGCTGACTTGCCAACGACG | SEQ ID NO: 1542 |
| SPTBN1 | ADXCRPD.3234.C1_at | TCCTTGTTTTCTTGGTTAGTGATTCATTTGCATAAACATTAATGATCTCTGCATACTGGT TTGGGGTTTTCTCTTTCCTTCTAACTCTAAAGAAAAAATTTTTGCTGCAGAATTATCCTC AGAAGAGGCTTCCTGGCCTTCATCTACCCTGCAGTCTGACCAAGTATGATAAATTTTAGC CGTTTTCAAGGAAACATCTCTCTACCCAGGTCATTGCTGTCACTACAGCTTTCAAGTCAC CACACTAATT | SEQ ID NO: 1543 |
| SEC61A1 | ADXCRPD.3290.C1_s_at | CAGCCCACGCTTAGGAATGCTTGGCCTCTGGCAGGCAGGCAGCTGTACCCAAGCTGGTGG GCAGGGGGCTGGAAGGCACCAGGCCTCAGGAGGAGCCCCATAGTCCCGCCTGCAGCCTGT AACCATCGGCTGGGCCCTGCAAGGCCCACACTCACGCCCTGTGGGTGATGGTCACGGTGG GTGGGTGGGGGCTGACCCCAGCGTTCCAGGGGACTGTCACTGTGGACGCCAAAATGGCATA ACTGAGATAAGGTGAA | SEQ ID NO: 1547 |
| NPC1 | ADXCRPD.11658.C1_at | GTTCTTACGGGTCTGAGCCTCTGGATGCTCTCTCAGATTTCTGCTGTGGATGAAGGGACT CAGCTGCTCGCTGCAGGTCACCTGACCTCCCTCATGCCGTCACCCATCCACTCTGACGGG TGGGTCATATGCAGAAGCTTCTCAGCACCTGGCCAAGTTGTAGCCGATGGTCTGTCCGAA AATGCTGGTTCACTCTCCACTGGCCAACTGTCTGTCTGCACTGCACTGCCAGTTGCCTCT TGCCTGCGCCATTGCGCTAACATC | SEQ ID NO: 1548 |
| VCAN | ADXCRPD.2656.C1_at | CTTTCCTCACACAATTTGGAATCATATAATATAAGTACTTTGTCCCTGATTAAATAATGT GACGGATAGAATGCATCAAGTGTTTATTATGAAAAGAGTGGGAAAAGGATATAGCTTTTT AACCAAAAGGTGTTTTGCCCCATTCCTAAGAAAATGGAGCGGATTAATATAGAAAATAA GTGTGGGGCATTTTCTTTCCCTGGTTAAGGGGGAAAATGGTATGTGGGTTTGAACATTTT TCTTCCCCCAATTGC | SEQ ID NO: 1549 |
| SVIL | ADXCRPD.9920.C1_at | GTGAGTCAAGAAGGCCCTCCCCTGTCGGCGTTTGATCTCTCCAGCAGCAAACATCGCACA TGGATTCTTGCAGAGCTTCTCCTGCGGCTGTTCCGAAGAATCCTGGGGCTTCCAGGACAC GGGGGCTGTGGTTTAAGCAATAGTTTTCCCAGCAGCTGTCCCCGTCTGCTCGGAAGTGGG CTCCCCGAACTCTGCCGCTCTTAGTGAAAACTTCCTTTTCATAACATTCTCCACCTCCAC CTTCTCTTCAAAGGGCAGCCTGTCCTCAAGTC | SEQ ID NO: 1551 |
| CAPN2 | ADXCRPD.9976.C1_at | TCGGCTCCGGTGACCGAGTACGCGTGCCCCTTCACCAGCTTCTGAAACGTGAATGGCCTC CGAGTCCCCGGCGCTGGTGATGTCGATGGAGCAGCCAAGGAGAGCCTTTTTGCAGAGC TTTCTGGATGATCTTGAACAGGTTGGGAGGGGGCTTCTTCAACTCATACCACTCAGCAAT GCTCCGGTGAAGTCTTCGAAGCCCTCAGTGGTGGCACCCCCTGATAGTGCTTCATAGCAT CCGTTGATCTTGCGTATGCCTTC | SEQ ID NO: 1552 |
| COL4A1 | ADXCRPD.3378.C1_at | CTAAGACTACTAAGGCCTTTTATGTAATTTCTTTAAATGTGTATTTCTTAAGAATTCAAA TTTGTAATAAAACTATTTGTATAAAAATTAAGCTTTTATTAATTTGTTGCTAGTATTGCC ACAGACGCATTAAAAGAAACTTACTGCACAAGCTGCTAATAAATTTGTAAGCTTTGCATA CCTT | SEQ ID NO: 1553 |
| COL4A1 | ADXCRAD_CN256234_s_at | ACCTTAAAGGCCGTCATTTCATTAGTATTCCTCATTCTGCATCCTGGCTTGAAAAACAGC TCTGTTGAATCACAGTATCAGTATTTTCACACGTAAGCACATTCGGGCCATTTCCGTGGT TTCTCATGAGCTGTGTTCACAGACCTCAGCAGGGCATCGCATGGACCGCAGGAGGGCAGA TTCGGACCACTAGGCCTGAAATGACATT | SEQ ID NO: 1554 |
| SNAPC1 | ADXCRPD.2725.C1_at | GAAAGAATCCATCCTTAAAGTCAAAAACTAATGATGGAGAAGAAAAAATGGAAGGAAATA CACAAGAAACGGAGAGATGTGAAAGGGCAGAATCATTAGCGAAAATAAAATCAAAGGCCT TTTCAGTTGTCATACAGGCATCCAAATCAAGAAGGCATCATCAAGTCAAACTCGACTCTT CGGACTCTGATTCTGCATCTGGTCAAGGCAAGTCAAAGCAACTAGGAAAAAAGAGAAGAA AGAAAGAGTGAAACCAGCAGGAAGGAAGATGTCTCTCTAGAATAATAC | SEQ ID NO: 1555 |
| SPTBN1 | ADXCRPD.2749.C1_s_at | AGAGAAGCGGTTCAGCCTTTTTGGCAAAAAGAAATGAACTCCTTTCCTTCACCTCCTGCC CTTCTCTTACCTTTTCAGTGAAATTCCAGCATGCAAGCTCAGAACCAACACATTACTCTC TGTGCCTAATGTTCCTCA | SEQ ID NO: 1556 |
| AHNAK | ADXCRPD.11792.C1_at | TCTGGTCCCTCAATGTCAATGTCTGGCCCACTGACATCCACATGTGGCCCTTTAAGGTCC CCTTCCAATGTGGGAACATCTACATCCACCTCTCCTTTTGCCTTGGGGCTCTTCAAGTGT AGATCGAGGTCTGGCATAGAGATTGTGGGAGCTTTAAAGTGCATATCTGGCATCTGGAAC TTAGAAGTTTTCCACTTGCCATTTGGGCCTTCCACAGCTACTTCTGGCATGCCAG | SEQ ID NO: 1559 |
| CORO1C | ADXCRPD.2786.C1_at | AAGTCTTCCTGTTGTACAGTCATCAAAATGACCAGGTTTGTGCTGCAAAGGAGCCAGCAC CATGTGGCTACTGCTTTGATTGTTCTCAGATGAATGTTTATACAAAATAATATCTTATCT TCATTTAGTTTATAAACATACACAGTGCTGTCCCTTTCAAATTAAGGANAAAAACCACAC ACACAAATACTGCAAAGTAGCAAAATACAAAGGAAAACAAAGCTACTTTTGGTTTTGGCA ACATTAAAAAGAAAGAAATATAAAAAGCAATGTGGCATTGGTCCCTATTCAT | SEQ ID NO: 1560 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|------|----------------|----------------|-----------|
| CALU | ADXCRPD.558.C1_at | GTAAACCAAGTTTTATATTCTGCAATGCGAACAGGTACCTATCTGTTTCTAAATA | SEQ ID NO: 1563 |
| CALU | ADXCRAD_CN403921_s_at | GATAATTTAATAATGCCACCAACTCTGGCTTAGTTAAGTGAGAGTGTGAACTGTGTGGCA AGAGAGCCTCACACCTCACTAGGTGCAGAGAGCCCAGGCCTTATGTTAAAATCATGCACT TGAAAAGCAAACCTTAATCTGCAAAGACAGCAGCAAGCATTATACGGTCATCTTGAATGA TCCCTTTGAAATTTTTTTTTTGTTTGTTTGTTTAAATCAAGCCTGAGGCTGGTGAACAGT AGCTACACACCCATATTGTGTGTTCTGTGAATGCTAGCTCTCTTGAATTTGGATATT | SEQ ID NO: 1564 |
| JAK1 | ADXCRPD.4023.C1_at | TGCATTTATTCAGCTGTCCAGTGTTCTCCAAGAAGCAAACTTGGATTTTCTTCTCTACTTT CCAAAGCTACTTCAGAGAAGCGCACTTCCGTGTGCGCCTGGGCCAGGCAGCGCCCCGTCG CTGCGCTGGCTGGGGTCGACCGGCAGGCTCGCTAGGCGGCCAGCCCCGCGGGGCCCCAGC GTGCGCGCGCCCAGGGCTGAGGAGGGGTCGCGGCGAGGACAGCCGGGACTGGGCGCAGG | SEQ ID NO: 1568 |
| MAPK1 | ADXCRPD.4057.C1_s_at | GAATCTGAATGTTTATTCATTATATTGTTACAATTTAACATTAACATTTATTTGTGGTAT TTGTGATTTGGTTAATCTGTATAAAAATTGTAAGTAGAAAGGTTTATATTTCATCTTAAT TCTTTTGATGTTGTAAACGTACTTTTTAAAAGATGGATTATTTGAATGTTTATGGCACCT GACTTGTNNNNNNNNNNNCTACAAACAAATCCTCTAGAATCATTAAATTGTGTCCCTGTA TTACCAAA | SEQ ID NO: 1569 |
| TSPAN4 | ADXCRPD.13071.C1_at | ACCCTGTTTCTGGAAGGCCCTAGCTCAGGTGGCTTCAGGGCCTCCGGACCCCCCCTGGGA GGGGTGGCCACGTGCTGGCTGCGGAACCCAGGGCAGGGGTGGGAGGGGCCTCCAGCACTT TTTATATTTACGTATTCTCCAAAGCAGTGTTCACACGGGAGCCAGCCTGTGCCCCCAGCC TCCTGGAAAACAGGTTGGCGCTGGAGGAGCCGGGTCTTGGCATCCTGGAGGTGGCCCCAC TGGTCCTGGTGCTCCAGGCGGGGCCGTGGACCCCTCACCTACATTCCATAGTGGGCCC | SEQ ID NO: 1570 |
| LAMB1 | ADXCRPD.12445.C1_at | AAGGCCAAGTGCGTGATCTTTGAGAGGTTTTGGTAGGTAAGAAAGGAGGACTCTATGCAT GTGTGATGGCAGTCGGGGGTGGTAATTTGGGAACACTTCATCTACCTTTGTTCCTTTGTT TGTACTGTTTTCTTAAACCTGTGGAATGTTTTCCCACTTCCCCTGCGCAAATCCCACCAG CCAACAGCTTCTTCAGCTACAACTGTAGCATTCCTCTGCAGTCTCTCCTTTGTCGACTTT CTTTCATAGTGACTGCATCTGACCTATTCTTGCCCTGC | SEQ ID NO: 1576 |
| PLAUR | ADXCRPD.3441.C1_s_at | CAGCCCTACAGACTTGCTGTGTGACCTCAGGCCAGTGTGCCGACCTCTCTGGGCCTCAGT TTTCCCAGCTATGAAAACAGCTATCTCACAAAGTTGTGTGAAGCAGAAGAGAAAAGCTGG AGGAAGGCCGTGGGCCAATGGGAGAGCTCTTGTTATTATTAATATTGTTGCCGCTGTTGT GTTGTTGTTATTAATTAATATTCATATTATTTATTTTATACTTACATAAAGATTTTGTAC CAG | SEQ ID NO: 1578 |
| IL6ST | ADXCRPD.11859.C1_at | AAATGCTTGGCCTAGAAGATGACATGCATGAAGACCCCCCAATACCACTGCTGTGTCCTT CAGTATTAATTTTTTCCTTTTTGAACAGGTCCAATGATTTCAGATCTTCTGGAAAAGGCT TATTGTCATTTGCTTCTATTTCCACAACACTTACATCAGTGAAATTGCCATCTGAATACA TTTGATCTTCCGAATTAAAATTGTGCCTTGGAGGAGTGTGAGGTGACCACTGGGCAATAT GACTCTTTGAAGGATCTGGAACATTAGGCCAGATGTGTAAACAATTAGGTCTCGCTTAT | SEQ ID NO: 1581 |
| CRIM1 | ADXCRPD.11873.C1_at | GTCCCTACTGCATAGAAGACACAATTCCAAAGAAGGTGGTGTGCCACTTCAGTGGGAAGG CCTATGCCGACGAGGAGCGGTGGGACCCTTGACAGCTGCACCCACTGCTACTGCCTGCAG GGCCAGACCCTCTGCTCGACCGTCAGCTGCCCCCCTCTGCCTGTGTTAGCCCATCAACGT GGAAGGAAGTTGCTGCCCATGCGTCCATGTAAGG | SEQ ID NO: 1583 |
| CRIM1 | ADXCRPD.11873.C1_s_at | TGCATTGATAGCGTAATTAGCTGTTTCTCTGAGTCCTGCCCTTCTGCATCCTGTGAAAGA CCTGTCTTGAGAAAAGGCCAGTGATGTCCCTACTGCATAGAAGACACAATTCCAAAGAAG GTGGTGTGCCACTTCAGTGGGAAGGCCTATGCCGACGAGGAGCGGTGGGACCCTTGACAG CTGCACCCACTGCTACTGCCTGCAGGGCCAGACCCTCTGCTCGACCGTCAGCTGCCCCCC TCTGCCTGTGTTAGCCCATCAACGTGGAAGGAAGTTGCTGCCCA | SEQ ID NO: 1584 |
| P4HA1 | ADXCRPD.653.C1_s_at | AGTATTTCACTACATCTCAGTTGGTGGGTGTTAAGCTAGAATGGGCTGTGTGATAGGAAA CAAATGCCTTACAGATGTGCCTAGGTGTTCTGTTTACCTAGTGTCTTACTCTGTTTTCTG GATCTGAAGACTAGTAATAAACTAGGACACTAACTGGGTTCCATGTGATTGCCCTTTCAT ATGATCTTCTAAGTTGATTTTTTCCTCCCAAGTCTTTTTTAAAGAAAGTATACTGTATT TTACCAACCCCCTCTCTTTTCTTTTAGCTCCTCTGTGGTGAATTAAACGTACTTGAG | SEQ ID NO: 1585 |
| AXL | ADXCRAD_NM_021913_s_at | GTTCTAACCCTATACTGTAGTATTCTTTGGGGTGCCCCTCTCCTTCTTAGCTATCATTGC TTCCTCCTCCCCAACTGTGGGGGTGCCCCCTTCAAGCCTGTGCAATGCATTAGGGATG CCTCCTTTCCCGCAGGGGATGGACGATCTCCCACCTTTCGGGCCATGTTGCCCCCGTGAG CCAATCCCTCACCTTCTGAGTACAGAGTGTGGACTCTGGTGCCTCCAGAGGGGCTCAGGT CACATAAAACTT | SEQ ID NO: 1586 |
| FNDC3B | ADXCRAD_BU665386_s_at | ACTACTTCTAATCTAATCACTAGAGTTATTATATTCTGTTATGTTTGACCAGAATTATAT GACAAGAACTGGTGACAGTTTAGTGCCTCTGCCCATTGTCCATGATTTACACTAATTGTG AGCAGTCTTCTTA | SEQ ID NO: 1587 |
| PPIC | ADXCRPD.13145.C1_at | CATTTTATCTGCTATAAGGAGAATTTTGGTAGGGCTAAAAGTGGAAGCAGTCCTTATCAG GAAACCCAAACATTTATAACTTTTGGGAATTTCTCACTCCTGGGACTGGCTTTAGAAAGT | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | GATCCAAAATTGTAAGGGGAGATCATCAGTGTTTTGGTCAGCCTGGCAATTTAGTCCACT TGCTCTGGTGATGGCTGCCCAATTTCTTATTTTCTTTTGAGAAATCACATCCTTCCCTC ACCCATCTCTAGTCCTTAGGGTGGGCTGACTCTACAGGATGGGTAC | 1590 |
| FLNB | ADXCRPD.13162.C1_s_at | AAGGACGGCACGGTCACTGTTAGATATGCCCCCACTGAGGTCGGGCTCCATGAGATGCAC ATCAAATACATGGGCAGCCACATCCCTGAGAGCCCACTCCAGTTCTACGTGAACTACCCC AACAGTGGAAGTGTTTCTGCATACGGTCCAGGCCTCGTGTATGGAGTGGCCAACAAAACT GCCACCTTCACCATCGTCACAGAGGATGCAGGAGAAGGTGGTCTGGACTTGGCTATTGAG GGCCCCTCAAAA | SEQ ID NO: 1591 |
| CCND1 | ADXCRPD.3501.C1_s_at | TCTGTCTGAACCACGCGGGGCCTTGAGGGACGCTTTGTCTGTCGTGATGGGGCAAGGGC ACAAGTCCTGGATGTTGTGTGTATCGAGAGGCCAAAGGCTGGTGGCAAGTGCACGGGGCA CAGCGGAGTCTGTCCTGTGACGCGCAAGTCTGAGGGTCTGGGCGGCG | SEQ ID NO: 1592 |
| CCND1 | ADXCRAD_BM551840_x_at | TGAGGGACGCTTTGTCTGTCGTGATGGGGCAAGGGCACAAGTCCTGGATGTTGTGTGTAT CGAGAGGCCAAAGGCTGGTGGCAAGTGCACGGNGCACAGCGGAGTCTGTCCTGTGACGCG CAAGTCTGAGGGTCTGGGCGGCGGGCGGCTGGGTCTGTGCATTTCTGGTTGCACCGCGGC GCTTCCCAGCACCAACATGTAACCGGCATG | SEQ ID NO: 1593 |
| FTH1 | ADXCRPD.13188.C1_at | AAGTGCAGGGTCAGTACTCCAGCGCCCTCTCATCAGACAATGAATTCTGACACTGGCTGT AAGTTTTCTGTGCAGTAATACAGATCCTTAAGACATTGCCCCAGGCAATGCCCATAATAT CCTAAAGGTTCCTTGAAGTTAAGTTTCAAGGATCAAGTTTCAGTTTTCTATTTTAGAATA GAAACATTACTCTTGGGTTCAATCCAGTAGCTCATCTGCCCCCCAGTCTCCTTAGGCACT GATTCCTTCATGCTGTGCTTTGA | SEQ ID NO: 1594 |
| PTPRK | ADXCRPD.13194.C1_at | ATCACATGAATATATCTGCCTGACAAAAATTTGGGAAGTCCAGCATCTCTGATTTAAAAA GAAGAAACTATTTGTAATTTTAGTCTCTTGTTCTTAATGCAGGATCTGACCATTGGTTAG TAATGCAACAGCTGCGATTAGCAATGAAGGAAAACTATTTTCAGAGTCTTCTCATGACCT AGCCACATTAGCAATCTAAAAATACAAACAGGAAAAGTTTTTAAAAGCTTAACCTTTTAT AAAGTGACTAAACTGCATAAGCCATCAGCCACAGA | SEQ ID NO: 1595 |
| PTPRK | ADXCRPD.13198.C1_at | CACCGGAGGTAGTTGATAGATCGAGAATACACAAGGACACTCACAGTCACACATAGAACC TAGAAACAACACTCCCCAAAACAGATGTAGATTCAACAAAATACTATAAAAAGCCATAAA GCATATTCAGTATATAATGTTTAAATTGTTCTGACATATATGTTGTTTGTATACCCGCAC AAATGTTACTGTCATTAAACTAATGATCCTATTTTCTTCTTCTCAAAAAAAGTCCTAGAA ATCTGTTTGTGATGGCTTGATGAAGTTTAGTCACTTTATAAAAGCCACCTTGG | SEQ ID NO: 1596 |
| KDELR3 | ADXCRPD.3569.C1_at | TACTTAGGCGAGTACCATTTGCACAATCACTGTTTTACTTATGAGCAGATACAGATATAT CCAAACCCTTACCTACTAGGTATCCTGCTAGGGTTTTCAATTCCAATTCTTGTATTAAGT TTTTTCCTTTCAGTTTTAGGTGCGAAAGTAATCAGTCAATCCAATATCCCCATCTTTGT CTTGAAACAAAAACTGTTTTAAGACGTCTACGTTGAATTATTCAGAGAATTAAGCAATAA AAGCTCACACCTTAT | SEQ ID NO: 1599 |
| VEGFA | ADXCRPD.3590.C1_s_at | GATTCTGATAAAATAGACATTGCTATTCTGTTTTTATATGTAAAAACAAAACAAGAAAA AATAGAGAATTCTACATACTAAATCTCTCTCCTTTTTTAATTTTAATATTTGTTATCATT TATTTATTGGTGCTACTGTTTATCCGTAATAATTGTGGGGAAAAGATATTAACATCACGT CTTTGTCTCTAGTGCAGTTTTTCGAGATATTCCGTAGTACATAT | SEQ ID NO: 1601 |
| CORO1C | ADXCRPD.2994.C1_s_at | GAACATTCTGGATAGCAAGCCCACTGCAAACAAGAAGTGCAGACCTGATCAGCATCCCAA GAAAACCACAGACACGGCCAGTGTGCAAAATGAAGCCAAGTTGGATGAGATTTTAAAAGA GATCAAATCTATAAAAGACACAATCTGCAATCAAGATGAGCCGTATTTCCAAGTTAGAAC AAGCAGATGGCAAAGATAGCAGCCTGAAGGTCCCACC | SEQ ID NO: 1604 |
| KIF2C | ADXCRPD.737.C1_s_at | AGCATCCTGCCTGCGTGGACTGGCTGCTAATGGAGAGCTCCCTGGGGTTGTCCTGGCTCT GGGGAGAGAGACGGAGCCTTTAGTACAGCTATCTGCTGGCTCTAAACCTTCTACGCCTTT GGGCCGAGCACTGAATGTCTTGTACTTTAA | SEQ ID NO: 1607 |
| TGFBR2 | ADXCRPD.4225.C1_s_at | AAAGACCAAGGAATAACATTCTGTAGTTCCTAAAAATACTGACTTTTTTCACTACTATAC ATAAAGGGAAAGTTTTATTCTTTTATGGAACACTTCAGCTGTAC | SEQ ID NO: 1610 |
| EPAS1 | ADXCRPD.4267.C1_s_at | TGCACGGCATTACCCCACACAGGGTGGCAGAACTTGAAGGGTTACTGACGTGTAAATGCT GGTATTTGATTTCCTGTGTGTGTTGCCCTGGCATTAAGGGCATTTTACCCTTGCAGTTTT ACTAAAACACTGAAAATATTCCAAGCTTCATATTAACCCTACCTGTCAACGTAACGATT TCATGAACGTTATTATATTGTCGAATTCCTACTGACAACATTATAACTGTATGGGAGCTT AACTTTATA | SEQ ID NO: 1611 |
| SYNJ2 | ADXCRPD.4271.C1_s_at | TTACTGTACCGCCTGTTGTATCTGGGAGCCTCGTACAGAGGCTCGCACAGCAGTGATCAA GTGTCATCCCTTACGTGACTGGGGGATGTCTGTCCTAAAAGCTGACTGCTAGGATAGTAA GGATCATCTTGCCTGGGCTATGCCACTGTCTTGTTACCAATTAGACATCTGGAATTTCAT AATTAGTTTTCATTGTCACTGTCAAG | SEQ ID NO: 1612 |
| JAK1 | ADXCRPD.3619.C1_at | CAGTTGTTGAAGTGTAGCAGCAGCTTTTTGCAGGGAAAGAGGGAGTTGTATTTATTGCTT CTCCATGACATGGTTCTTTTCTCATTAGTTCATGGGCAAGTCAAGGGAAAGAGACCTAGG | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|------|----------------|----------------|-----------|
| | | TAGCAGCTGAGTCTGTAGCCTACAGATGGCCTGGGCTGGCTTGGCTCAGTCACTTCCCTT AGTCACTTCCACACATTCCAGAAATT | 1613 |
| PHACTR2 | ADXCRPD.12664.C1_at | TTATACCAAGATCAAACAAAGCCATGATTTCTGTTTCACTCTGCATTGGGCTAATTGATG TTTGGACAGTTCAATTCTGATAACAGCAGCGCACACTCTAATTCTCTCTGGGAAGTGAAG GAAACACTGCCCTGTATTTTCCTGACTTCAGGCTTATACTCTGGCAATCTTCCAAAAACT TCCCATGGCTGCCCATCTTACTTCCAACAATCCCTGAAC | SEQ ID NO: 1614 |
| PPP4R1 | ADXCRPD.4310.C1_s_at | ATACCTTGAGGGAAGTCTGCGATGATGAAAGAGATTGTATTGCTGTTTTGGAAAGAATTA GCAGATTGGCCGATGATTCAGAACCAACTGTGAGAGCGGAGCTGATGGAACAGGTGCCTC ACATCGCACTGTTTTGTCAAGAAAACCGGCCTTCAATACCATATGCTTTTTCAAAATTCT TACTACCTATTGTGGTTAGATACCTTGCAGATCAGAATAATCAGGTGAGGAAAACAAGTC AGGCAGCTTTGCTGGCTCTGTTGGAGCAGGAGCTCATTGAACGATTTGA | SEQ ID NO: 1620 |
| FLNA | ADXCRPD.13338.C1_at | GGTAGGCGTCAATGTCACTTACTGGAGGGGATCCCAGCCCTAAGAGCCCTTTCTCAGTGG CAGTATCTCCAAGCCTGGACCTCAGCAAGATCAAGGTGTCTGGCCTGGGAGAGAAGGTGG ACGTTGGCAAAGACCAGGAGTTCACAGTCACAATCAAAGGGTGCTGGTGGTACAAGGCAA AGTGGCATCCAAGTATTGTGGGCCCCTCGGGTGCAGCGGTGCCCTGCAAGGTGGAGCCAG GCCTGGGGGCTGACAACAGTGTGGTGCGCTTCCTGCCCCGTGAGGAAGGGCCCTATGA | SEQ ID NO: 1621 |
| CTSA | ADXCRPD.13357.C1_at | GGGATAGCAAAGATAGATCACTAACAGCGATAGGACCCCAGAGTAGCACAGCAAGCTGGG GGCCCTATGAGACTTCCTGTCAGGACAAGGGAAGCTGAAACTCCGAAAGGCGAAGCCCAG GGTCCTGTGATTGGTGGGGTCAGAATTTGAACCTGGGTTTGTCCCCACCCATGCTGTCCT GCTATAGGAGGCCTAGGGGTCTGCATCAGCCACGGAGTCTTAAGGGTGAGAAGAGCTTCA TTCATGCCAAAAATGGGCCAGCAGAT | SEQ ID NO: 1625 |
| ZDHHC7 | ADXCRPD.12706.C1_at | TTGGTCCGGAGCCACCTGCGGACAAGCGTTCTGCCTGGGTCTTGGCTCTTGGCGTTTCTT TGCAGCTCCATCTCTCCGAGTGCTCCCATCTGATACACGTTTCAAAAGTTCAATTCCAGG GTAGCCAAAAGTGTGAAGCTGCCATGGAGAAGGGCTAAAAAACAACCAGGAACCAAGCAA CCACT | SEQ ID NO: 1626 |
| ADAMTS1 | ADXCRPD.13363.C1_at | TATGATGCGATCACAACCAGCTTTTACACACTGTCCTTGCACACAGACAGAGGTGGAATC TGGGCTACATGGAGTACCATCTACAACCTTGGGCTGCAAAACGAAGAAGTAGCCAATGCC TTTGGCTTGGCAGATGAGCTTGCACCTGTCCTTTGGTGAGACGCCAGCGTACTTGGGAAT CCATTCCACCGCAGGCCCACTCCCAAAGGAAGCTTTTGAAAACTCGTTGTGTGCTTCACA TT | SEQ ID NO: 1627 |
| PMP22 | ADXCRPD.5015.C1_s_at | AAATCATAAAGCCTTCATCACTCCCACATTTTTCTTACGGTCGGAGCATCAGAACAAGCG TCTAGACTCCTTGGGACCGTGAGTTCCTAGAGCTTGGCTGGGTCTAGGCTGTTCTGTGCC TCCAAGGACTGTCTGGCAATGACTTGTATTGGCCACCAACTGTAGATGTATATATGGTGC CCTTCTGATGCTAAGACTCCAGACCTTTTGT | SEQ ID NO: 1634 |
| KCMF1 | ADXCRPD.14034.C1_at | ATTGCCAAGTGGAGATAAAGGTGTCCATTTGGGTAGGGTCAGGAAGCTGTGGTATTCATG CCTCATGGCCTTTCATTTTCTTAGAGCCGTAGGGGTAAAATCATGCCATTTTTTGCCTCT GTGCCTCATAAGTTTGTACTCCTTCCTCCTTTAAAAATCAGCTGTAAGAGCTGGATGTGC TGTA | SEQ ID NO: 1635 |
| SPTBN1 | ADXCRPD.13403.C1_at | GGGCAGACAGGAGGGCATCCTTCTTCCTGTCAACCAGTTCTCTGAACTGGCTCCACCTTG TGTTGAGTTTGTCCTGCTGGGCTTTGATTTCCTTCTCACTTGGGTGGCCGCTGTGCATCA GCTGGCGTGCCATCTGGTTCACCACTGCAACCCGGGAAGCCTGGTTGTTCATTTCTGTTT CTACGGCTCTCAATCTGTGCTGGATGTACCTCCACGATCCTCCAGCTTCTCTGGGATCTG CATGTTGTTGAGCCACTGCTCCTTTCGTCGATCCAGAGCTCACGGCATAGC | SEQ ID NO: 1639 |
| PPAP2B | ADXCRPD.13412.C1_s_at | ATGTTCTGGCAGGATTTGCTCAAGGAGCCCTGGTGGCCTGCTGCATAGTTTTCTTCGTGT CTGACCTCTTCAAGACTAAGACGACGCTCTCCCTGCCTGCCCCTGCTATCCGGAAGGAAA TCCTTTCACCTGTGGACATTATTGACAGGAACAATCACCACAACATGATGTAGGTGCCAC CCACCTCCTGAGCTGTTTTTGTAAAATGACTGCTGACAGCAAGTTCTTGCTGCTCTCCAA TCTCATCAGACAGTA | SEQ ID NO: 1641 |
| PTPRK | ADXCRPD.14082.C1_at | ACTAATATGTTCAAAGTGCCAGGATTCAGTCCTTTCTGGCTATATAATAGGTAACTGAAA TCAATGCAGTGAGTGTCGTTCTCCTTCATTGTAGGCAGCTGAAGTCTGGCTTTTTCTCCA GGGTCGTGATCTGAAGAGTCCACTATCATATAGGAACCTTGGGCATCTCGGGTGGTAGA TAATGAGGCTCTTGAGCACTAACATGCACCCATTCAAAGTCATCATACAGATCCTGGTGG TAATCACAGGCCCCTGGAC | SEQ ID NO: 1647 |
| MARCKS | ADXCRPD.4423.C1_at | TTCAACAAAGAAACTCAACAGATCCAAGAGGGGAAACAAAGAGCCTCGGGTTGGTGTAAC GACGGGGCGAGCAGCAGCAGCAGCGGCGGCCAACAGCGGCAGCCTACAGCACACCGGAGG AAGGGGGGTGGGGGTGGTGGAGAGGACAGAACAGAACCGATTAAATACACTCCGGATAAA AAATTTTAGTCGAAGAGATCAAAAAGCAGCAGCACAGGAGGGGAGGGAAAAAGGGTGGAA AAGTCGAGCACCAAAAAAGGAGCCCCAGT | SEQ ID NO: 1648 |
| MARCKS | ADXCRPD.4423.C1_x_at | CCCATGCTGGCTTCTTCAACAAAGAAACTCAACAGATCCAAGAGGGGAAACAAAGAGCCT CGGGTTGGTGTAACGACGGGGCGAGCAGCAGCAGCAGCGGCGGCCAACAGCGGCAGCCTA CAGCACACCGGAGGAAGGGGGGTGGGGGTGGTGGAGAGGACAGAACAGAACCGATTAAAT | SEQ ID NO: 1649 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | ACACTCCGGATAAAAAAATTTTAGTCGAAGAGATCAAAAAGCAGCAGCACAGGAGGGAGG GAAAAAGGGTGGAAAAGTCGAGCACCAAAAAAGGAGCCCCAGT | |
| ARID5B | ADXCRPD.12803.C1_at | GATTCTCTAGTATGTAGGACAGTTTCACAGCCTAGATAAGGTAAGTACAATGCTCAATAT TTTCACAGAACCCAATACTTCAAAGCAAAGCATTTGGCTGGGTAAGCAGTGTATAAGCTC TTTCAACTATGCCATTTATGAGGAACAAAATCCTTAAGTTGCGGATCTACAAAGGAACGT TCTTTGCACTATTGTGTGCTTGACTGTTTCTTTTTCATTTGTTCCACTAGAATCAGTTAG CTTCAATGTGTAACAACACGCGCG | SEQ ID NO: 1652 |
| COL5A2 | ADXCRPD.12854.C1_at | ATGTGCACGTCTTGCTCACGAGCAGTTCTATTATACATTTAGCTAACAAGTAAACAGCAT ATATTACATCATCAACTTGGTGATATAATAAGAAATACTACAGAATTAAAAAACATAATG TGGATCAAATCATCCTTGCTTAAATACATCAAGAACTTCCCAACTACTTAA | SEQ ID NO: 1654 |
| COL5A2 | ADXCRPD.3875.C1_s_at | GGGACCATCCCAAAAGACAAGCCATGCATACAACTTTGGTCATGTATCTCTGCAAAGCAT CAAATTAAATGCACGCTTTTGTCA | SEQ ID NO: 1656 |
| FNDC3B | ADXCRPD.14126.C1_at | ACCATGGCAACGAGGTAGTCTGTTCTATTTTTGGAGTATGAAAGTAGTGCCTTCTTAAAT CTAATAATAAATGAGAGTTCCAGAAAACCAGTGCTTCAAACAAATTTGATTTA | SEQ ID NO: 1658 |
| TFE3 | ADXCRPD.14170.C1_at | CCTTTTGAAGGCACGGCAGAACGAAAGACATCAACAACCTTAATTTGAGCGTCGCAAGGC GATTCCAACATTTACCGACAGGAATCAGGGAACTGGGGCCTCCTCATCCTAGTCCAGTGA CCGGAGA | SEQ ID NO: 1660 |
| ID3 | ADXCRPD.4520.C1_s_at | CCCAAGTTCTAAGGTCTTTTCAGAGCGTGGAGGTGTGGAAGGAGTGGCTGCTCTCCAAAC TATGCCAAGGCGGCGGCAGAGCTGGTCTTCTGGTCTTGTTCTCCTTGGAGAAAGGTTCTGTTGCCC TGATTTATGAACTCTATAATAGAGTATATAGGTTTTGTACCTTTTTTACAGGAAGGTGAC TTTCTGTAACAATGCGATGTATATTAAACTTT | SEQ ID NO: 1661 |
| SGCE | ADXCRPD.12912.C1_at | GTTGGATGTCTGGTGTATGCATGTAATCTCTTTTCCACGCCTTCCCGTCGGCAGCACATG ATATAAAGCAAGTATTAGACAAAAGGACCAGTTGCCACTGCCGAGGGCACAGCCAGTGTA ATCAGGAACTCCGTGTAATAGTCTCTGCTTTTCAAAGAATCAGAAGGGGGTTAGTATTCT CCCACCATCAGGTAAAATCCCCTCTCCAGGAATTACTTCTTGATAGTGGACCCTTGCTTG TTTATCACCAATG | SEQ ID NO: 1663 |
| FNDC3B | ADXCRPD.13581.C1_at | CCGGATTAGAAGCAGTCAGCCTGAATGTATACTGTGTGCTTCTTTTGAGATTTTTCACAG TACAGGTTAAATCCTCTCCAGTGTATTTTGGGTGGAAAAGGTTATCATTTTCATCCTCCT GAATTTCCAAGGTGTAGGTGATCACTTCCTCGGGTGAACAGCCTTCTGGCTTACTCCACT GCAACGTGACCCATGTGATGCCAATCTCGAACCAGCCTTGGTGCAGAAGGCATCTGAGGGA TATTTCCTAATGTGTAGCACACCACCTCTTGGCTATAACCACTGGTACCAATGTCGTTTC | SEQ ID NO: 1667 |
| KCMF1 | ADXCRPD.13587.C1_at | GATGGATATCTTTGTCAGTACATATAATTCTATTTGGTTCTCTTTAATGGTCACATAGTA AGACTTATTATATTAGGGTCAGCAAAGTATGGCCTCTAGACCAAATATGG | SEQ ID NO: 1669 |
| LMNA | ADXCRPD.3925.C1_s_at | TTGAGCTGCCTTCCCTAGCTTTAGACCCTGGGTGGGCTCTGTGCAGTCACTGGAGGTTGA AGCCAAGTGGGGTGCTGGGAAGGAGGGAGGGAGGTCACTGGAAGGGAGAGCCTGCTG GCACCCACCGTGGAGGAGGAAGGCAAGAGGGGGTGGAGGGGTGTGGCAGTGGTTTTGGCA AACGCTAAAGAGCCCTTGCCTCCCCATTTCCCATCTGCACCCCTTCTCTCCTCCCCAAAT CAATACACTAGTTGTTTCTACCCCTGGC | SEQ ID NO: 1671 |
| MARCKS | ADXCRPD.3926.C1_at | AATCCTCCCGTCTCTCCAAAACCATCTCCCCGTCCCCTGACATTGCGGCGCTCTGANNNN NNNNNNNNNNNNNNNNNNNNNNNNNNNNNNNNNNNNNNNNNNNNNNNNNNNNNNNNNNNN NNNNNNNNNNNGAGAGAGCTTTTTGGCGCGCGCCTTTCCCCTGGCGCTTTTCTCCCCGGG AGGATTGTTCTCCACTTTTCGCCCGTCATAGCCTAAATCCG | SEQ ID NO: 1672 |
| LOXL2 | ADXCRPD.4590.C1_at | GGGTTGCTCTGGCTTGTACGCTTTCCGGAATCTCGAGGGTCCGTCAGGGCTGAAGACCTG CCCAGGCACACAACTCACCACGCCGGTAGCCCATTCTCGCAGGTGACATTCTTCATGGG GTCCAGTGACACCTGGGGGCCCAGCTTGCAGCTGGAGATGTGGGCCTCTGTGCCGGTGCA GTCCATGGAGAATGGCCAGTAGCGCTGCTTCCTCCGTGAAGCACACATTTTGTACACTTT | SEQ ID NO: 1674 |
| YWHAZ | ADXCRPD.12994.C1_at | AAAATCTCCCTTCCAATGCCAGGAAATCTCCTCTAACATAATGAATTTCCACCCCACCA CTATCCCTTACATTTCTTTAAATTCAAGATCACTTTTCTTCTTAAAAAGTAATCAGAGAA TTTATAAACTAAGGGTCCTTAGACCAAACCCCAAAATTATGAACAAGAACTCAATCATTA AGTATTTGTACATTCACCTCAGTCCTGAAGAATAGCCAACCTGCCACTATACACTCAAAC CACCGTGCTATGTGCTGAGATTTGGGCTTGCCAACCATCTCCGGGAT | SEQ ID NO: 1678 |
| CCND1 | ADXCRPD.3980.C1_s_at | GGAGGTGGACCTGGCTTGCACACCCACCGACGTGCGGGACGTGGACATCTGAGGGCGCCA GGCAGGCGGGCGCCACCGCCACCCGCAGCGAGGGCGGAGCCGGCCCCAGGTGCTCCCCTG ACAGTCCCTCCTCTCCGGAGCATTTTGATACCAGAAGGGAAAGCTTCATTCTCCTTGTTG TTGGTTGTTTTTTCCTTTGCTCTTTCCCCCTTCCATCTCTGACTTAAGCAAAAGA | SEQ ID NO: 1679 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| SERPINH1 | ADXCRPD.5216.C1_x_at | AAACTAGGTGCTGCAGCCCCTGGGACCAGGCACCCCCAGAATGACCTGGCCGCAGTGAGG CGGATTGAGAAGGAGCTCCCAGGAGGGGCTTCTGGGCAGACTCTGGTCAAGAAGCATCGT GTCTGGCGTTGTGGGGATGAACTTTTTGTTTTGTTTCTTCCTTTTTTAGTTCTTCAAAGA TAGGGAGGGAAGGGGGAACATGAGCCTTTGTTGCTATCAATCCAAGAACTTATTTGTACA NNNNNNNNNNNCAATAAAACTTTTCCCACCCCCCTCACACCTCTTCTCCCTAGAATA | SEQ ID NO: 1680 |
| NT5E | ADXCRPD.5241.C1_at | CACAGAGTTCTTGAAACCCACGATTCTTCTTCAAATCCAGATGTGTGTGAGCCCCACCTC ATCAACTCTGAAGGCTGAAGGATCAGCTGGAATTTCTGCTGCAGGGTGTCCCTGATAAGC TCAAAAGCATCAGAACGGAGGGAGCTTTCTCCCCTTCTCTCATCTCATTAAAATGAGCTT TCTTGTTGTGGGGGGTTGGGGAGGGACCTTTAAAACCAAACAATGGTGCCCTCTTATCAT CTTTTNCTGTCCTCCTTTCTCCAAGTTTCCAGAGGG | SEQ ID NO: 1683 |
| PEA15 | ADXCRPD.14289.C1_at | AAATCAGCACATTCCTCCTACTTCCCTTTCCTCCACTCCCCCCATATCTTTAAAGTGTGG AAGCAGAAAGGACCTGCATTTTCCTACATTGAGGAGCTGACATAGGGGTAAGGTATGGGA GAGGTAGGTGGATCCAGGGAAAA | SEQ ID NO: 1684 |
| PEA15 | ADXCRPD.14289.C1_s_at | AAAAGCCAGAGTTCCATGTTTGTACTCCTTGTGCTGGACTGTTTCCTGAGTACCAGCAGG TCCCTTTTTGTCTC | SEQ ID NO: 1685 |
| PEA15 | ADXCRPD.14289.C1_x_at | AAATCAGCACATTCCTCCTACTTCCCTTTCCTCCACTCCCCCCATATCTTTAAAGTGTGG AAGCAGAAAGGACCTGCATTTTCCTACATTGAGGAGCTGACATAGGGGTAAGGTATGGGA GAGGTAGGTGGATCCAGGGAAAAGCAGTGGGGACGGAAGGCAAGAGACCACTCAACCCCC ACCTGGAAGGGGCAAAGAAAAGCCAGAGTTCCATGTTTGTACTCCTTGTGCTGGACTGTT TCCTGAGTACCAGCAGGTCCCTTTTTGT | SEQ ID NO: 1686 |
| IL6ST | ADXCRPD.13648.C1_at | GATAGACCATCTAAAGCACCAAGTTTCTGGTATAAAATAGATCCATCCCATACTCAAGGC TACAGAACTGTACAACTCGTGTGGGAGACATTGCCTCCTTT | SEQ ID NO: 1687 |
| IL6ST | ADXCRPD.13648.C1_x_at | ATATGTGTATAGGATTCGCTGTATGAAGGAAGATGGTAAGGGATACTGGAGTGACTGGAG TGAAGAAGCAAGTGGGATCACCTATGAAGATAGACCATCTAAAGCACCAAGTTTCTGGTA TAAAATAGATCCATCCCATACTCAAGGCTACAGAACTGTACAACTCGTGTGGGAGACATT GCCTCCTTTTGAAGCCAAT | SEQ ID NO: 1688 |
| GJA1 | ADXCRPD.13657.C1_at | TTTTAGAATTCTGGTTATCATCGGGGAAATCAAAAGGCTGTGCATGGGAGTTAGAGATGG TGCTTCCCGCCTGCCCCATTCGATTTTGTTCTGCACTGTAATTAGCCCAGTTTTGCTCAC TTGCTTGCTTGTTGTAATTGCGGCAAGAAGAATTGTTTCTGTCGCCAGTAACCAGCTTGT ACCCAGGAGGAGACATAGGCGAGAGGGGAGCGGTTGGTGAGGAGCAGCCATTGAAATAAG CATATTTTTGAGACCCACAGTCTTTGGCAGGGCTCAGCGCA | SEQ ID NO: 1689 |
| CD59 | ADXCRPD.5301.C1_s_at | AACCCACTGGTGCAAGTCCTAGATTCCAAAGGCTGAAGAACCTGGAGTCTGATGTCCAAG AGCAGGAAGAGTGGAAGAAAGCCAGAAGACTCAGCAAACAAGGTAGACAGTGTCTACCAC CACAGTGGCCATACCAAAGAGGCTACCGATTCCTTCCTGCTACCTGGATCCCTGAAGTTG CCCTGGTCTCTGCACCTTCTAAACCTAGTTCTTAAGAGCTTTTCCATTACATGAGCTGTCT CAAAGCCCTCCAATAAA | SEQ ID NO: 1692 |
| LPP | ADXCRPD.5328.C1_s_at | GAGCTATAGTACATGTGTGTTATGAATGAAATATGACAGCATGTTCCATACCCCTGCTTT AGCCATCTGTGGGAAACCAGCAAACTGAAAAGACACCTCTGCAAAATGTGCCTCAAGTC CATTTCTTGGGATCGCTCGTTTGGTGCACTCTCGTGGGAGACAATCAGAGAACAACATAT ACTTGTGCCTTATTTTCA | SEQ ID NO: 1693 |
| KCMF1 | ADXCRPD.14355.C1_at | GGATAACTGCTCTATATGTGGAGAACATTAGAACAAAGGGACCTGAAGTTATATTTCAGT GTCTTAGCGAGGATTTCAGGAACTGCTTGGTATGAAGAGTTGTGTCAGGGTGAGTCTGTT GTACTTCCCCAGCTAGAACAAGTCATCTTTCATCATTTTCATATGTTTGGCTTTGTTTCT GTAGGTCTCTATCCCTTAGTCTTCATACTGTTTTAAATGCTTATTTACTTATCCTTATTC CCCATTTAGGCTCTAAGCACTAAGTGGGTACTGCAAGTGCTCAAAAATTTTG | SEQ ID NO: 1695 |
| CDC42BPA | ADXCRPD.15053.C1_at | TGTACTCCAGCTAGCACAGGCAGACGTGTAAGAGACTTTTGCACTTTATGTACCCATCCT GAGGC | SEQ ID NO: 1699 |
| CDC42BPA | ADXCRPD.15053.C1_x_at | TGTACTCCAGCTAGCACAGGCAGACGTGTAAGAGACTTTTGCACTTTATGTACCCATCCT GAGGCCTTTTCCCCTCTCTCATCCTTTTGCCATGTCCTGTGGT | SEQ ID NO: 1700 |
| SPTBN1 | ADXCRPD.15064.C1_at | GGTATTCCCAGAGCCGGATGACATTGTCCTTCCTCGCTGTGATGCGCTTGATGTCGTGGT AATTATCGGCCTCGAGCTAACTGGCCACGGCTACCACAGCCTGCACACGCTCCTCGTATG CGGCAATGTCTGTCTCAATGCCTCGTGCTTTTTTGTGGCGGACTCAACTGCAGGAAGGT CAAACCCAAAGTTGTCCTGAGACACCAGACGCTGCTTTTCGCTCAGCCAAGTCTCCCTCA TAGCTGCATTGCGATCAAATCTGCGGGCGAGCTGTTCCAGT | SEQ ID NO: 1701 |
| TGFBR2 | ADXCRPD.13821.C1_at | TTTGTGTCCCACATTCAAATCCTCTCTAGTAATTTCTGCAAAGGTTGAGAAGGCTGGCAT GATGGAGAGAACGGTAACCATGAGGAAAGCTTCTTGGAGTAAAGCACTCCTCTCTCCAAT | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | GCAGAGGGTAAAACTATTAACATATAAGCAAAAGAAACTTGGGCTAACTGAGACCCTTAA AGGAGTTCCCCTTTAGTCCAATAAAAGGCCAACTTCAAATCTTTACACCAGATAAGGTAG TCAAGATCATATCATATACCCAGAGAATGACTGCTTGTATGGACATTTCCTAC | 1706 |
| IL6ST | ADXCRPD.14481.C1_s_at | TGTTTACTAACATATATTGACCAAGTACATCAAGCAGGAGAGATCTTCCTTCATTCTGTT ATAGTCCACATCATTCTAATTTTGCTCAGTTGTTATTAAGAGCATATTCCTAAACCATAC ACTTTTGTTTCAATAAAGTTTTATTTTGTTGAGATGAATAAAATAACAAAGTTATAAGCT GCATAAGACAAAAGTTCAATT | SEQ ID NO: 1707 |
| FAM50A | ADXCRPD.13832.C1_s_at | AATCCAACATTGACAAGAAGTTCTCTGCGCACTACGACGCGGTGGAGGCAGAGCTCAAGT CCAGCACCGTGGGTCTCGTGACCCTGAATGA | SEQ ID NO: 1708 |
| FLNB | ADXCRPD.13858.C1_s_at | ATGCTGTTCGCTTCATCCCTCATGAGAATGGTGTCCACACCATCGATGTCAAGTTCAATG GGGCCACGTGGTTGGAAGCCCCTTCAAAGTGCGCGTTGGGGAGCCTGGACAAGCGGGGA ACCCTGCCCTGGTGTCCGCCTATGGCACGGGA | SEQ ID NO: 1710 |
| HSBP1 | ADXCRPD.4853.C1_at | CAACTACAGAACCTCCTTTGATCAGGCCAGTAGGTTGTGATGCAGGCTGGAGCCCCCGAA TGCCCCACACACACTGCAGCATTGACCAGACCATCCGAAACCTGCGTCCCTGGTGATGTT CTCAAGCCTCGGAAGTGGCAAATGGAAATGATATGGCCGGTTGCCGGTTGTAGGAGAGTTG TGACTTAGGCAGGAGTCGACCTCCTCAAGTAATGGAACGATTTCAAAGGCAGGCTGCCCT GACCAAAAATATCTGCCATGAATAAAGGTGCCTGAAATCCTGCTATGAA | SEQ ID NO: 1713 |
| TGFBR2 | ADXCRPD.13873.C1_s_at | AAACATCAAATATTCCCAGGAAATTGGTTTTATTGGAGAACTCCAGAACCAAGCAGAGAA GGAAGGGACCCATGACAGCATTAGCATTTGACAATCACACATGCAGTGGTTCTCTGACTG TAAAAC | SEQ ID NO: 1714 |
| KCMF1 | ADXCRPD.14509.C1_at | AGCATTGACAGCAATACTGCTTGTGGTATCTGAACTTCAATACAACATGTCTGTTATGGA CTTGCATTTGAAGCCATCACATTTATAGAGTATCTGACTTCTTCATTACTTCTTTAAATA ACTTCCTAAGCATCTGTATCTTGAAAGGCATATTATCACATATTGTTTTCATTTGTCCTT TACATTTGAGCATTTTAC | SEQ ID NO: 1717 |
| CDC14B | ADXCRPD.5520.C1_at | ACTCCTCCGCGGAAGCATGGAGGGAAAGGAGGTTGTAAAATAGACTCCATGGAGACTCTT AGGAAGCAGTAGATTCCCGGGGGCTGTGCCTTTAGCGTTAGAGGAAACACATAGAGCTGG AACTGTTAATGGAAAGCAGTCACAGCTGAGTTTTCCGAGACCAAGAAATTA | SEQ ID NO: 1718 |
| CDC14B | ADXCRPD.5520.C1_x_at | TCGAGAGCAGGCCATTTCCCAAGAAGATGAAGAATGGTGACTGTGTTTTTATTGAAGGAA TTTCAAATGAAGAATAATGTTTAAAATGTGTATATAGAGATAGTATAGACTCCTCCGCGG AAGCATGGAGGGAAAGGAGGTTGTAAAATAGACTCCATGGAGACTCTTAGGAAGCAGTAG ATTCCCGGGGGCTGTGCCTTTAGCGTTAGAGGAAACACATAGAGCTGGAACTGTTAATGG AAAGCAGTCACAGCTGAGTTTTCCGAGACCAAGAAATTA | SEQ ID NO: 1719 |
| CCND1 | ADXCRPD.13939.C_1_at | TTCACATTGTTTGCTGCTATGTGGAGGATCAGTGTTTTGTGTTACAATGTCATATACTGC CATGTACTAGTTTTAGTTTTCTCTTAGACATTGTATTACAGATGCCNNNNNNNNNNNNNN NNNNNNNNNNATGTGATCAATTTTGACTTAATGTGATTACTGCTCTATTCCAAAAAGGT TGCTGTTTCACAATACCTCATGCTTC | SEQ ID NO: 1727 |
| CASK | ADXCRPD.4921.C1_at | GGGAATTGCTGGTTTCACCATTTCAGATCTGTGTTGTCTAAGAGTATTAACGTTTTAATT AAGCAAAGAAATGATTTTTAATCTGTATGTAATTGTTTTAAAGCACCCATTTTAAGAGAA AATACTGTGCAATGAAGAAACCAGTTTAGGCATTTGCTATAAACTGAAATATTCCAAAAG AATCATCTATAACAGCCCTGTAAATTCCTTTAAAATGATAACTAACAGGACAGTTTGACC AATTTTTTTTAAATACTTCCTTTTATGTGTTCAATAATTAAATGCCTTTGGGTCCT | SEQ ID NO: 1729 |
| FLNB | ADXCRPD.6237.C1_at | AAATTAGGTCATGGGTCTGGGATCAGATTCTGTGAAGTTACTGAGCTTCAGGACCTGCAT GTGTTTGTGTGCATGTATGTGTCCCCTGTGTATGTGTGAATGAGAGAGGGAAGAAAAAGA AGAAAGAGAAGCTTTACTTGGAGATATCTGCCTCTATTATGAAGGACTCTCAAGTAACAGCC TTTTGATGTAAAGAGCAGCTTCCACTGTCTCTGAAACTGCAGCGAGTTGACAGGTGATGC GGCTGCATTTAGGAAGCCTGGACCCTCTAC | SEQ ID NO: 1730 |
| LPP | ADXCRPD.14604.C1_at | AATACCGAACTAATGGTCCTTGTCTCAATGACCTGCCTATCCTTTGTCCCTTCATGGGAA TCTTCTCACAGATCAAGTTACTATGATCTACAAGGCCATTCCCATAGCCTCGTTCCACT TACACACGATCTTAACCATTTCTGTCCAGTGGGAGTCACCCACTCACCTCCTAAAACCTC TATGCATGCCCCATACCCCTAGTCATAATACTCTTATACAAATGTTTAACACTTTGCAGT TGAAGACCCAAT | SEQ ID NO: 1731 |
| JAK1 | ADXCRPD.6270.C1_at | GGGATGTAACCTGGCTGAGGTGGGAACCTGCACCCGACTTTTGACAACCATCCCTCATGG CCGGTCCACCTGCCTTTGAAGAAGACCTTGAACAAGGTGGCAGGGGTGGCCCCACAAGGC AAGTTTCAGGAACTTTTTCAAAATCCAAGGGGCAAAAGGGGCCCCTTAACGTTCCTGGC CACGGTTTCGGGAACGGCAAACCTTCTCCCACACTTGGGGGAGAGACCTCCCTTGAACGC CCCCGCTCTAAAGAAGACA | SEQ ID NO: 1735 |
| AHNAK | ADXCRPD.15294.C1_at | CGTTAAAGGGAACACGAGTATCTCTGCGACCGGTC | SEQ ID NO: 1736 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|------|----------------|----------------|-----------|
| AHNAK | ADXCRPD.15294.C1_s_at | AGGTGGTGTCACTGGCTCACCAGAAGCATCAATTTCTGGGTCCAAAGGTGACCTGAAAAG TTCAAAGGCCAGCCTGGGCTCTCTGGAAGGAGAGGCATGAGGCCGAAGCCTCTTCACCGA AAGGCAAATTCTCCTGATTTAAAAGTAAGAAGCCACGGCACCGCTCAAATTCATTCAGTG ATGAAAGAGAGTTCTCT | SEQ ID NO: 1737 |
| PPP4R1 | ADXCRPD.5630.C1_s_at | ACGTATAATGTATGTCTGGTGTTTTTAACTTGATCATGATCAGCTCTGAGGTGCAACTTC TTCACATACTGTACATACCTGTGACCACTCTTGGGAGTGCTGCAGTCTTTAATCATGCTG TTTTAAACTGTTGTGGCACAAGTTCTCTTG | SEQ ID NO: 1738 |
| GRB10 | ADXCRPD.15300.C1_at | CAGAGGTGTGAAGGCTCGCCATAGAGGAGGGCTTGTTGAGTGTCACTCCTGGAGCCTACG GAGTCGCAGGGAGGCCTGGCATGGTCAGGTAGACTTGGTAAGGCCTGACTGCTGGGGAAT GTATCCTGCCAATAGATTCCTGGGCCTGGAACAGCTCTTCTTTGGACACATGCCATCCAT CTTTGGAATAAGACAATCTGGCATTTATGTACCTGGTGGGTTACC | SEQ ID NO: 1740 |
| HK1 | ADXCRPD.6337.C1_s_at | ATCGTGCACGGCAGTGGAAGCCAGCTTTTTGATCATGTTGCTGAGTGCCTGGGAGATTTC ATGGAGAAAAGGAAGATCAAGGACAAGAAGTTACCTGTGGGATTCACGTTTTCTTTTCCT TGCCAACAATCCAAAATAGATGAGGCCATCCTGATCACCTGGACAAAGCGATTTAAAGCG AGCGGAGTGGAAGGAGCAGATGTGGTCAAACTGCTTAACAAAGCCATCAAAAGCGAGGGG ACTATGATGCCAACAT | SEQ ID NO: 1742 |
| FAM50A | ADXCRPD.6370.C1_at | TGGGACAAGTACACGATCCGCTGAGCATCCAGGAGGCTGCGCGGCCCCGGCTCCTCAGCT CCCTCAGTGTGCCCCGTGGTGTCACCGGGACTCCAGGCACCCGCTCCCCTGCGACCATGC CAGGCACGCTGGGAGGAGGACGGCAGCTGCTCGTGTCCTGCCCCTGCCACATCAGTGACT GCTTTATTCTTTTCCAATAAAGAAGTGCACGTGTCAGAGCTGGAGCGCCTGCATTGTGAG AAACCAA | SEQ ID NO: 1743 |
| FAM50A | ADXCRPD.6370.C1_x_at | GACAAGTACACGATCCGCTGAGCATCCAGGAGGCTGCGCGGCCCCGGCTCCTCAGCTCCC TCAGTGTGCCCCGTGGTGTCACCGGGACTCCAGGCACCCGCTCCCCTGCGACCATGCCAG GCACGCTGGGAGGAGGACGGCAGCTGCTCGTGTCCTGCCCCTGCCACATCAGTGACTGCT TTATTCTTTTCCAATAAAGAAGTGCACGTGTCAGAGCTGGAGCGCCTGCATTGTGAGAAA CCAA | SEQ ID NO: 1744 |
| CD59 | ADXCRPD.15392.C1_at | GGGCTATTGAGAGTCAGCACCAGCACTGATCATATATAGGATCAGCCTACTGGGGTTGGC CACGTTGTATGTAGCTGCGAATAGCAAGGAGGGGAACAGCAACATCCCTAGGGAAACCGA TCACAGAAAGGCAGCTCACTACCCCACAGTAAAAAGAACCTTGAGTTTCCCAGTTCAGTC CCCTGCTGGGTGCATGCTACCCCCCTCCTCTCCCAGAGGCTCTGGACCTACACAGCTGCT GAAAAAGAGAAAATGTCCTTACCTACAATGAACCATCACAGGCACCCA | SEQ ID NO: 1745 |
| RCN1 | ADXCRPD.14742.C1_at | GTTGCAATTGTCTCTCACTGACGTATTTGAAGGATATTTGAGCTGGAAAGCTCAACCAAA TGATGCGTTTTTGCTAATATGATGACTTCTCCATAGACTTCTTTAGATTTATATATGTTC CTGTGCACTTATCAACCTTCTCATAGTGCCTCCTGGCTTATCATGGCTTTTGAAAGAATA GAGGATCTTTGTCACTTTGAC | SEQ ID NO: 1746 |
| ZDHHC7 | ADXCRPD.5764.C1_s_at | AAGAGCTGCGTCACAGCCAGAGGGACAAAGTGTGGGTGATCCTGGAGACGCCAGTTTCCG AGATTGTTCTGCATATTCATTTGCACATTGTTGTCTGGGTTGGACATGCGTGTGGGCTTC AGTGTGAGGCTTTTAATATGTATATCCTGTTATCAATAAAACAATTATCCAAGTGGTTGA ATCCTGTGAGACTTGGCAAGTGTGTGCAAATCAAGTATACTTGACTTTTCAACCTCTT | SEQ ID NO: 1747 |
| CDC42BPA | ADXCRPD.16014.C1_s_at | AAGAGCCTCTCCCTGGAGAGCACTGACCGCGGGAGCTGGGACCCGTGAGCTGCCTCAGCA CTGGGACCTCTCGCTCTCCGCTCCCTGCCACTCGCCTCCTCTCACTTTCATCTCTTCCCT CCACCTCGCCTGCTCGGCCTGAAAGCCACCAGGGGCTGGCAGCAGTAGCAGGACAGGGAT TCAGGAGTTCTGACGACACGACTCTCAGATCCACGCCCCCAGCCTAACAGCAACAACAAA GACAGACTTTCC | SEQ ID NO: 1749 |
| COL4A1 | ADXCRPD.7020.C1_at | GGACCTAAAGGTGATCCAGGTATAAGTGGAACCCCAGGTGCTCCAGGACTTCCGGGACCA AAAGGATCTGTTGGTGGAATGGGCTTGCCAGGAACACCTGGAGAGAAAGGTGTGCCTGGC ATCCCTGGCCCACAAGGTTCACCTGGCTTACCTGGAGACAAAGGTGCAAAAGGAGAGAAA GGGCAGGCAGGCCCACCTGGCATAGGCATCCCAGGGCTGCGAGGTGAAAAGGGAGATCAA GGGATAGCGGGTTTCCCAGGAAGCCCTG | SEQ ID NO: 1750 |
| KCTD12 | ADXCRPD.7032.C1_s_at | AGATGCAGTCAAAGTCTTTTCAGACATGCCCAAACTTTGAGAATTTCTTCAACCATCTAA TGCTATAAAGATTTTGTTCTTCCTGTTCACAACCAGTTGTATAACAGAAATACTAGCTA CTGTTTTCCTTCCTGTGTGTGAAGTAATGAATCATTGATTATGTGACTTGTTATGTATTC AATTA | SEQ ID NO: 1751 |
| CCND1 | ADXCRPD.16054.C1_at | ACCAAGTAGCTGTGGGTTGAACCTGGACGTGAGCTGGTTGCAGGGCCGTTGGGTAGAAAA CCAGCATCTCATAAACAGGTCACTACAAAAATAGGAAGAGTATAAAAATAGAAATATTA TGTCACTATTTCGTCTTCTCTTTATAGTAGCGTATCGTAGGAGTGGGACAAGGTGGCCTT TCCCGACACTGCTACGCTGGTCTGTGCCCGACAAACCTCACCTGATGTTGTACCTGAGTA CGTTACTAAATCCTCAAGACCTTACACACAGC | SEQ ID NO: 1752 |
| ITGA5 | ADXCRPD.16092.C1_at | AGGCCACAGGGTTCCCCTCTAAGCTGCAGCTCCGCTCCTCTGGGTTGAACATGGCGGGGA AGATGGTGAGGGAGGCACTAGCGGACACGATGGGGCGGCCCCTGTATACCACAGCCTTGT | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
|  |  | CCACACCAAAGGACCCCACAATCAGATCAGGATATCCATTGCCATCCAGGTCTCGGCCTC CTCGAAGGGCAGAGCCAAAGAAGTCTGGGGTGTGGCTGGCTGCCCACAGGGGCTGCAGAA CCTGGGAAGGCTTAGAGCCCA | 1754 |
| ITGA5 | ADXCRPD.16092.C1_x_at | GTTGATGCAGGCCACAGGGTTCCCCTCTAAGCTGCAGCTCCGCTCCTCTGGGTTGAACAT GGCCGGGAAGATGGTGAGGGAGGCACTAGCGGACACGATGGGGCGGCCCCTGTATACCAC AGCCTTGTCCACACCAAAGGACCCCACAATCAGATCAGGATATCCATTGCCATCCAGGTC TCGGCCTCCTCGAAGGGCAGAGCCAAAGAAGTCTGGGGTGTGGCTGGCTGCCCACAGGGG CTGCAGAACCTGGGAAGGCTTAGAGCCCA | SEQ ID NO: 1755 |
| PRSS23 | ADXCRAD_BM979373_s_at | AAAAGGACTCATGGCATTATTAATATAATTAGTGCTTTACATGTGTTAGTTATACATATT AGAAGCATATTTGCCTAGTAAGGCTAGTAGAACCACATTTCCCAAAGTGTGCTCCTTAAA CACTCATGCCTTATGATTTTCTACCAAAAGTAAAAAGGGTTGTATTAAGTCAGAGGAAGA TGCCTCTCCATTTTCCCTCTCTTTATCAGAGGTTCACATGCCTGTCTGCACATTAAAAGC TCTGGGAAGACCTGTTGTAAAGGGACAAGTTGA | SEQ ID NO: 1761 |
| FKBP9 | ADXCRPD.16135.C1_at | GGGCCATCATCAGAATTTGCACAGGCTGCTGGGAAGAGCCATGGCTGTCTGCTGGGAACT CTGCTGGGGCAAGCAAGCCCTTTGACTCTCCTGCCCATCTCAAGAATATTT | SEQ ID NO: 1762 |
| FKBP9 | ADXCRPD.16135.C1_x_at | GGGCCATCATCAGAATTTGCACAGGCTGCTGGGAAGAGCCATGGCTGTCTGCTGGGAACT CTGCTGGGGCAAGCAAGCCCTTTGACTCTCCTGCCCATCTCAAGAATATTTCTAA | SEQ ID NO: 1763 |
| CASK | ADXCRPD.14972.C1_at | CTAAAACCACTAGCCAGAGCAGGAGTACATAAACAGCAAAAATAAATCCCGCAGAAAAGG AGATTCTGATTTATAGAGTTGACACATAATATTATTTAAGACACTCAGTTTTCAACAAAA AATTATGAGGCATGCAAAGAAACAAGAAAATATAGCTCACACTTAGAGGGGAAAAGCAAT CCCATAGAAACTGTTCCTGAGCAAACCCAGATGTTGGACTTACAAGAAAAAGAGTTACCA AATGGAAAGTATCAAT | SEQ ID NO: 1767 |
| YES1 | ADXCRPD.16243.C1_at | GTATCAGTGAGGTAACAGCAACCAGACAAAGTGGGTGATAAAATTTGATGGCATTAGATC TACAGCTGGAGGGAACTGTAGGGAAGAGGAATATGTTAGATAACATGCAAAACCCATAAG ATTAGCAAAACAGTTTTTCCTAAAGATTAAATTTTATATGCTTTCACTCTCAACATTAGG ATACTTCAGTACAAGAGTTTAGATAGTAACCCAACTAAAGTAATACTGATCGCTGAATTT CAAGTGAGCTCAAAGGTCTCCTTCCC | SEQ ID NO: 1770 |
| VEGFA | ADXCRAD_BX116668_s_at | CACTGGCAGATGTCCCGGCGAAGAGAAGAGACACATTGTTGGAAGAAGCAGCCCATGACA GCTCCCCTTCCTGGGACTCGCCCTCATCCTCTTCCTGCTCCCCTTCCTGGGGTGCAGCCT AAAAGGACCTATGTCCTCACACCATTGAAACCACTAGTTCTGTCCCCCCAGGAGACCTGG TTGTGTGTGTGAGTGGTTGACCTTCCTCCA | SEQ ID NO: 1771 |
| CD55 | ADXCRPD.7256.C1_at | TTCCTTTGTTGCACAAATAGAGTTTGGAAAAAGCCTGTGAAAGGTGTCTTCTTTGACTTA ATGTCTTTAAAAGTATCCAGAGATACTACAATATTAACATAAGAAAAGATTATATATTAT TTCTGAATCGAGATGTCCATAGTCAAATTTGTAAATCTTATTCTTTTGTAATATTTATTT ATATTTATTTTATGACAGTGAACATTCTGATTTTACAT | SEQ ID NO: 1772 |
| FLNA | ADXCRPD.15612.C1_at | GCTACACCATTATGGTCCTCTTTGCTGACCAGGCCACGCCCACCAGCCCCATCCGAGTCA AGGTGGAGCCCTCTCATGACGCCAGTAAGGTGAAGGCCGAGGGCCACTGGCACTCAGTCG CACTGGTGTCGAGCTTGGCAAGCCCACCCACTTCACAGTAAATGCCAAAGCTGCTGGCAA AGGCAAGCTGGACGTCCAGTTCTCAGGACTCACCAAGGGGGATGCAGTGCGAGATGTGGA CATCATCGACCACCATGACAACACCTACACAGTCAAGTACACGCCTGTCCAGT | SEQ ID NO: 1773 |
| CRIM1 | ADXCRPD.15616.C1_at | ACAGATGTCACAGCCGTGCTTATTCTTCAGCAATCCAAGTGGACAATACTTGTCACAGAT TATGGGTCTGCACTTCTTGGGCCTTGGGCGGCACTCACAGATCTCACAGTTTTGGGCATC AGTAAGGAAACCGAAGGGACAGTTCAAGGTGCAGCCTTGTTTACGTTCTGAACATAGTTC CTCGGTGTTTATGCACTCACAGGTCCGACAACCATTGTGATCGCGTTTGAAACCATTAAT GCAGTCCTTCCCTGTCAGAGTGCAGTTTGATACGGTCCCGAC | SEQ ID NO: 1774 |
| SPTBN1 | ADXCRPD.15631.C1_at | GAAATCCAGGGTGCACCTAGCCTCGCGATTGACGACATCTTTGAGAAGGAGCCAAAACAT CGTCACTGACAGCAGCAGCCTCAGCGCTGAGGCCATCAGACAGAGGCTTGCCGACCTGAA GCAGCTGTGGGGTCTCCTCATTGAGGAGACAGAGAAACGCCACAGGCGGCTGGAGGAGGC GCACAGGGCCCAGCAGTACTACTTTGACGCTGCTGAGGACGAAGCCTGGAT | SEQ ID NO: 1775 |
| FLNB | ADXCRPD.15647.C1_at | AGGCTTCTGCGGGTCCCAGGATTCGCAGTCTGGGCACAGACCTGGAGCACAGCTGTCTAC CAGGGCTCCCAGGGCTTTGCCTTGCCAGTTCTGGTTAAAGTTGGTGATGGGCAAGTA GGGGATCTTGTTCTGAATCCACCCCAGCAGCCTCTGCTTTGGCGTCTGCTCTTGGCATC ATCATCCCCTTCATCCTCNCACACGGCATGGAGATGGAGTAGTGGAGATCAGCGCCAC AGACCTAGATGAGCTCAGTTCCATCACAATGGCTTGCTATCGATGACACGA | SEQ ID NO: 1776 |
| PDLIM7 | ADXCRPD.15669.C1_at | ATGGCTTACCTCACTTCAGGGAGGCTGTGAGAAGCACTCAGAATCTGGATGTGCCTTGGG GGTGGGCCCACTGGACTTTCCTGGTGACCTGGTGTGGGGTGTGAGAGGAGGGTGTGTT TGGCTGCAGCAGACAGGAGAATGGAGTTGCCACTCCGCGTGATGGGGATGGCTGTGGGAG GAGAGGTCCTGGTGGTGAGGGAATCCGGATCTGAGTGCTGTACCCTGGCAAGTCTGAACG CGCAGTGATCGCTCCACTCACGAGAT | SEQ ID NO: 1777 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FNDC3B | ADXCRPD.7332.C1_s_at | GAGAAGTGCCCTAATTGAATGTGTTTGAATGTTATCCTTGCACAATTCTTTAAATTGAAA GATAAAATGTTTTACCTCACTGTTGGACATACATTCCAAGCTTTTCAACTCTAGGAGAAA AAGAAAATCATGTTTTCCTGTATTGTAAATTTTAGACTATTTCATATACATTGTATTAAA ACTGCCATATCAATTTTAATGTATAGATTTTGCAAATATTATGCTATATGTAATACCTAA CTGTATCTGTAGTG | SEQ ID NO: 1780 |
| COL6A1 | ADXCRPD.8056.C1_at | CTCGGGACCTGTGGTACCCAGGAATGAAAGGAGAA | SEQ ID NO: 1789 |
| COL6A1 | ADXCRPD.8056.C1_s_at | ACGTACCGGCGCAACTTCACGGCGGCTGACTGGGGCCAGAGCCGCGACGCAGAGGAGGCC ATCAGCCAGACCATCGACACCATCGTGGACATGATCAAAAATAACGTGGAGCAAGTGTGC TGCTCCTTCGAATGCCAGCCTGCAAGAGGACCTCCGG | SEQ ID NO: 1790 |
| ZDHHC7 | ADXCRPD.8057.C1_at | CGGGCCTCGGATCCGATCACATAGGACAGTATGCACCTTAAGATCCTGAAGAAACGGCAC AAAATGTTCAAGTGATGTTTAGAAATAACTTGTGAGGGTGCGTCAGGGAAATCATGCAGC CATCAGGAGACAGGCTCCGGGACGTCGAGCATCATCCTCTCCTGGCTGAAAATGACAACT A | SEQ ID NO: 1791 |
| IGFBP3 | ADXCRPD.17075.C1_at | TGCTCTGCATGCTGTAGCAGTGCACGTCCTCCTTCCCCTTGGTGGTGTAGCCTGGGAGAG GCTGCCCATACTTATCCACACACCAGCAGAAGCCCCGCTTCCTGCCTTTGGAAGGGCGAC ACTGCTTTTTCTTATAAAATCCCTTCTTGTCACAGTTGGGAATGTGTACACCCTGGGAC TCAGCACATTGAGGAACTTCAGGTGATTCAGTGTGTCTTCCATTTCTCTACGGCAGGGAC CATATTCTGTCTCCCGCTTGGACTCGGAGGAGAAGT | SEQ ID NO: 1792 |
| PTPRK | ADXCRPD.6814.C1_s_at | TATAGCATATGATCACTCCAGAGTGATTTTGCAACCCGTAGAGGATGATCCTTCCTCAGA TTATATTAATGCCAACTATATTGATGGCTACCAGAGACCAAGTCATTACATTGCAACCCA AGGTCCCGTTCATGAAACAGTGTATGATTTCTGGAGGATGATTTGGCAAGAACAATCTGC TTGCATTGTGATGGTTACAAATTTAGTTGAGGTTGGCCGGGTTAAATGCTATAAATATTG GCCTGATGATACTGAAGTTTA | SEQ ID NO: 1797 |
| NFIB | ADXCRPD.15832.C1_s_at | TTCTATTAATATCCTCTTGCATGCTTTAGAAGCCAAAGGAAACAGCCCCCACANNNNNNN NNNCCTAAAGCAATGGTTTCAGTTAAGCCAGGCCCATGGCATCTTTGGAGACAGAAAGCT ACCCTTTCCATTCACGGCAACATGACATTCACAATGTGCTTTCCTAAATGGATGGAAAAC CCCTCAAAAAAGCCCCTCAAATCTGTGTTTCATAAACTGTACTCTTAGCAATAAAGTTTA TTACAGACCTAAAGTATCTGCATAAACCCGGTTAAT | SEQ ID NO: 1799 |
| EGFR | ADXCRPD.15857.C1_s_at | TTTGAAACTCAGTATGCTGCCCCTGTCTTGCTGTCATGAAATCAGCAAGAGAGGATGACA CATCCAAATAATAAACTCGGATTCCAGCCCACATTGGATTCATCAGCATTTGGACCAATAG CCCACAGCTGAGAATGTGGAATACCTAAGGATAGCACCGCTTTTGTTCTCGCAAAAACGT ATCTCCTAATTTGAGGCTCAGATGAAATGCATCAGGTCCTTTGGG | SEQ ID NO: 1801 |
| WNT5A | ADXCRPD.6842.C1_s_at | GTTTGAACCTAGAATATTGAATTAAAATGCTGTCTCAGTATTTTAAAAGCAAAAAAGGAA TGGAGGAAAATTGCATCTTAGACCATTTTTATATGCAGTGTACAATTTGCTGGGCTAGAA ATGAGATAAAGAT | SEQ ID NO: 1802 |
| CDC14B | ADXCRPD.8104.C1_s_at | AAAATTGTTCATTTTACTGGCTCTGATCAGAGAAAACAAGCAAATGCTGCCTTCCTTGTTG GATGCTACATGGTTATATATTTGGGGAGAACCCCAGAAGAAGCATATAGAATATTAATCT TTGGAGAGACATCCTATATTCCTTTCAGAGATGCTGCCTATGAAGTTGCAATTTCTACA TTACACTTCTTGACTGTTNTCATGCAGTAAAGAAGGCAATGCAGTATGGCTTCCTTAATT TCAACTCATTTAACCTTGATGAATATGAACACTATGA | SEQ ID NO: 1804 |
| PDLIM7 | ADXCRPD.8148.C1_at | GCAAACCGCAGAAGGCCTCCGCCCCCGCCGCGGACCCTCCGCGGTACACCTTTGCACCCA GCGTCTCCCTCAACAAGACGGCCCGGCCCTTTGGGGCGCCCCCGCCCGCTGACAGCGCCC CGCAGCAGAATGGACAGCCGCTC | SEQ ID NO: 1808 |
| PDLIM7 | ADXCRPD.8148.C1_at | GAGAATGCGGGTAGCCTCACACACATCGAAGCTCAGAACAAGATCCGGGCCTGCGG | SEQ ID NO: 1809 |
| CYP1B1 | ADXCRPD.8150.C1_at | GCAAGACGTCAACAGGAACCCGCAGGCCCGGCCTGGACACCTGCTGCCCTCACTGGAAGC TTTAACTCCCACTCGAGTCTCTTGGCGTCGTCAGTGCCAGGAGCGCTTGGATTGGGATGG GGACGGAGAAGGGTGCCATCGCTCGCCGAGCCCCGCTGCACCTTGGGGACCTGGCAAAGT CGAGGTTTCCTCACAGCGTTGAGATTGAGACTGGGGGTCGGTGAGTGGCGTCAATTCCA TGCCCTTGCGGCCATCTCACAACTGGAGTCGCAGAAGCGCTCGCT | SEQ ID NO: 1810 |
| COL6A1 | ADXCRPD.6917.C1_s_at | TGGCTGCACTCAAGACCCTCGAGATTAACGGTGCTAACCCCGTCTGCTCCTCCCTCCCGC AGAGACTGGGGCCTGGACTGGACATGAGAGCCCCTTGGTGCCACAGAGGGCTGTGTCTTA CTAGAAACAACGCAAACCTCTCCTTCCTCAGAATAGTGATGTGTTCGACGTTTTATCAAA GGCCCCCTTTCTATGTTCATGTTAGTTTTGCTCCTTCTGTGTTTTTTTCTGAACCATATC CATGTTGCTGACTTTTCCA | SEQ ID NO: 1815 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| GALNT2 | ADXCRPD.7576.C1_s_at | GAGGAGAACTCTTGAAATCTCCATTTTCAATCCCTTCGAAATCACGTATGGTTTCCACAA AGCCGAGTCGTGTCACGTGGCAGGTTTACGTCAATAGTCCCTCTCTCTGCTCCTCCATTC GCAAGTGTCTTCCTGGGCCAGACTCCCCTCCACCTCATGTACTTGCTATATTGAGGATGA AGTTTTCTATGGTGGGACACTAAATATAAAGCTATATAGAGAAAGAATGTACGGTCAGTT CCCTATGGTTT | SEQ ID NO: 1816 |
| CCND1 | ADXCRPD.15960.C1_at | TGCCCGACAAACCTCCACTGGATGGTTTGTCACTGGATGGTTTGTTGGGGTGGTGGTCAC AGGCGCAAAGGACATGCACACGGCCACGCTACGCTACTGTAACCAAG | SEQ ID NO: 1817 |
| VCAN | ADXCRPD.6973.C1_at | TTGAAACTGTGCCACTGACCTTTACTTCCTCCTTCTCTACTGGAGCTTTCGTACCTTCCA CTTCTGCTGTTGGTAAAATGGTGGATCTTCTATCAATTTCAATGACAGTACCCACTTCTC CCAATCCTTCGTCGATAATGGAGGAAGCTGTACCAGAAAACTTTTGCACAGCACTGGGAA GCACTGGAACAACAGAGCTGCTGACTGTGACCAGTTGCTCACCTGAGCCCTCAGCTGAGG ATGTAAACTCTTCCCAGGGGAAGGCTGAAGTGCTGACCATGGTGCTA | SEQ ID NO: 1818 |
| CREB3L1 | ADXCRPD.15997.C1_at | TCCCAAAGTTAGGTGGCCCGTCGCAGGCAGCCCCTAGTAGTCTGGCCTCCTCGCCCGCAC AACCCTTCACCCACAGGCCAGGTGCAATCCCGATGCAGGCTCCTGGCCCGACCCTCTACG CGCTCAGGCGGACAGCTAAGGTCTGGCTGAGTCTCCGGCAGGGGCGTTTGGAATGTGACC GGTCACCCACTCTCCGGCCCTGCATTTGCTTGTGCATGCAAGTCCACAGGTGTAGAGGCAC CCGAACCGTGTGCAT | SEQ ID NO: 1819 |
| CASK | ADXCRPD.17222.C1_at | CACAGATCTGCTCCATCCATAAAATTCGAAAACCATGTAAAGCATTCCATCTGAGCTATAT GTCTCCAATAACTCTACAATGTGTGGATGTTTCAGCATATGACAGATACTGGCTTCCCGC TTTAGATCTTCTGTACTTAACCCTGGACTTGATGTGAACTTGGCTACATCAACAATTTTT ACAGCAAATTGTTGCCCAGTTTCTCTGTTGATACATCGTCGTACAACACTGAAGGGACCC TTTCCGATCA | SEQ ID NO: 1822 |
| MICALL1 | ADXCRAD_BP398250_s_at | ATGGTCATCACTGGTCTGTCTGCTCTGTTGTCTGTTCTTTCCCTGACTCCCTCCCACCGA AGGCCTGATGGCTACTCACCCCTCTGGGATGGCTATGGGAGAGGAGGAGTGATGGGGACC GCCACCTTTTCTGCAGGAAATGTGCCCAGCAGCTCTTGGTCAAAGCACTGTTGCTATAAG CTATCTCTGGGATGCCTCTAGGCCCCCTTCCCTCTACACACCTCTGGGAAAAGATTACAC TGTATTAACTCTCGAGGAGTTTCCTCACCAA | SEQ ID NO: 1823 |
| SYNJ2 | ADXCRPD.8240.C1_at | GCCAATGTGGGACAGAAGAGCAACCCAGGAAATACAAAGCAAGCGCTGTCAAGAGTGAAG CCGAAGCCCCCTCACACTCTCTAGAGGGGAAGCAGCATCGTGCTGTGATGACCAGGAAG GGATTACCGAGGGTCCGTTACTAGAACACTGAGATCAAACGGAAGATCCAGATGTGTCTA CAGATGCCAGTCTTTGGGCTGCTACTGTCCTTACAAACTCATGTC | SEQ ID NO: 1824 |
| LPP | ADXCRPD.16626.C1_s_at | CTAGATGATTCCAGTGCCCTTCCATCTATCTCTGGAAACTTTCCTCCTCCACCACCTCTT GATGAAGAGGCTTTCAAAGTACAGGGGAATCCCGGAGGCAAGCACTTGAGGAGAGGCGC TCCAGCCTGGACGCTGAGATTGACTCCTTGA | SEQ ID NO: 1828 |
| MARCKS | ADXCRPD.8271.C1_at | CCGTCCTCGGCCTTGGGCGAAGAAGTCGAGGAGGCGGCCGACGCGGCCTCTCCCTCCGCG GCCGTGGGCGAGCCGGGCTCGGCAGCCTCGCCTTCCGCGGGGGCCTCCTTCTCTACCGGG CTGGCCCCGGCCTCGGGGGCAGCGGCGGCTGCCGGCTCACCTTTCGCGGCCGCG | SEQ ID NO: 1829 |
| MARCKS | ADXCRPD.8271.C1_x_at | CCGCTCAGCTTGAAAGACTTCTTGAAGGAAAAGCGCTTCNNNNNNNNNNNNCGGGGTCTCG TTGCTGGGCGAGGGCGTGGCCCCGTCCTCGGCCTTGGGCGAAGAAGTCGAGGAGGCGGCC GACGCGGCCTCTCCCTCCGCGGCCGTGGGCGAGCCGGGCTCGGCAGCCTCGCCTTCCGCG GGGGCCTCCTTCTCTACCGGGCTGGCCCCGGCCTCGGGGGCAGCGGCGGCTGCCGGCTCA CCTTTCGCGGCCGCGAAAGGCGACGCCGCCCCGCTCCCGGCGGACGAGGGCTCCTCCTTG | SEQ ID NO: 1830 |
| LPP | ADXCRPD.16635.C1_at | TTAGTTAAGAACATGACCCGAAGAGTGAAAGGTATTTCCTGTTCCAAATAGGAGCCCAGT CTGCATTTTCTACTACATGATTTAGTAGAAAGACACATTGCATTTGAACCATATTTCTTC TGCTAGCCAATTCCATCTTATCTACAACTTTTTGATAATTATTTTGAGAAATAGATCTAG ATCACAGCCTTCCAATTCCTAGGCCAGGATACTT | SEQ ID NO: 1831 |
| LIF | ADXCRPD.16683.C1_s_at | TCACTGAATCACAGAGCCTTTGCGTGAAACAGCTCTGCCAGGCCGGGAGCTGGGTTTCTC TTCCCTTTTTATCTGCTGGTGTGGACCACACCAGGGCCTGGCCGAAGGAAGAGAGAGTTT ACCAAGAGAGATGTCTCCGGGCCCTTATTTATTATTTAAACATTTTTTAAAAAGCACTG CTAGTTTACTTGTCTCTCCTC | SEQ ID NO: 1833 |
| PRSS23 | ADXCRPD.10010.C1_at | AGGCTACATATGGATCTTGGTCTCATAAAAAATAAGCACTAAAATTAAGTTGAGTTGAGG TTGAGTTTAGAGTTAGTGCTGCTCATGCCACCCTAAGCTTCCAAGTATCATTCAGTCACA TCTTGTTTCCTGCTTTGGGGTTATTTAACAGGTCATTCGTGAGTTATTACATAACTGGAA CAAAAGCAAGATAGAATCAAAAGAATACTTAGAGCTGGAGTGACATCAGAAACTGTATGC AACCTCCTTATTGTCAGGACGGGAAAAGGCAAGTCTGGGAAGCAATA | SEQ ID NO: 1834 |
| TMEM158 | ADXCRPD.7689.C1_at | AACAAATACACAGGATTTGGTCATTTTCTGCCATGAATCTAGGGCACGTGGGTGCCGGGA AGGAGTCGGCAGGGGATGCAATAGAGGGGAAAGGGCCCCATTTCCCTCCTCTCCGTCT TCGGAGCTGCGATCCCACCCTCAGTCCAAGGGCTTAAACATCTGCTTTTCGGAACTGGAA GCGCAGCACAAACCTTG | SEQ ID NO: 1836 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| TMEM158 | ADXCRPD.7689.C1_x_at | AACAAATACACAGGATTTGGTCATTTTCTGCCATGAATCTAGGGCACGTGGGTGCCGGGA AGGAGTCGGGCAGGGGGATGCAATAGAGGGGAAAGGGCCCCATTTCCCTCCTCTCCGTCT TCGGAGCTGCGATCCCACCCTCAGTCCAAGGGCTTAAACATCTGCTTTTCGGAACTGGAA GCGCAGCACAAACCTTGCTTTTCAAAGGCGCTGGG | SEQ ID NO: 1837 |
| FHL1 | ADXCRPD.10038.C1_at | TGCAGAAGAGTCAATCTACCTAAGTTTTCATTTTTAAATTGCAGCCGGACAGAAATTCAC TTTGCTGCAGGGTTGCTTTTTGCTAAATGCTAATATGATCACTGTGTGCCCTTATTTGAG TAATACTGTAAAATGGGAGAAAAGACGGAAGGAGAACTTTAAAGAAGGGAAGGACCACTC TTCCCCTATTGATGGTATAGGGCAGAAAGTAAGGACACAAAGAACGAGATTCAAATGCCA TTTTACAGGACAGGAGCCCCTGTCAGTTTACAGCTTGAGACACGCGACGGGTACCGAG | SEQ ID NO: 1838 |
| MAP1LC3B | ADXCRPD.1021.C1_at | ACCCTGAGTCTTCTCTTCAGGTTCACAGAACCCGCCGCCTTT | SEQ ID NO: 1839 |
| MAP1LC3B | ADXCRAD_CX870302_s_at | ATCCAATCACAGATCATGAAACAGTAGTGTTCCCACCTAGGAGTGTTAGGAAGTTGTGTT TGTGTTTCAAGCAGAAAACTGAGCTCCAAGTGAGCACATTCAGCTTTGGAAACTATATT ATTTAATGTAGGCTAGCTTGTTTTCAAATTTTAAAAGTTTAAAAATAAAATACTTTGCAT TCTAAGTTGCCAATAAAATAGACCTTCAAGTTATTTTAATGCTCTTTTCTCACTAATAGG AACTTGTAATTCCAGCAGTAATTTAAAGGCTTTCAG | SEQ ID NO: 1840 |
| MAP1B | ADXCRPD.10066.C1_at | GTTTGGGTCAGTCTCCACCTGGGTATGGTATTATGTTTTATAATCCTGCATCACTTCTAT CCTATCCAGTCATATTTAATGTAGAAAATTAGTTTCCAGTGAAAGTAAAATGTAGGGCTT TTATGAAATTTGTGGGCAAAATCCCC | SEQ ID NO: 1843 |
| OPTN | ADXCRPD.1062.C1_at | GAGAATGATGCTTTCGAAGACGGAGGCAGGCAGTCCTTGATGGAGATGCAGAGTCGTCAT GGGGCGAGAACAAGTGACTCTGACCAGCAGGCTTACCTTGTTCAAAGAGGAGCTGAGGAC AGGGACTGGCGGCAACAGCGGAATATTCCGATTCATTCCTGCCCCAAGTGTGGAGAGGTT CTGCCTGACATAGACACGTTACAGATTCACGTGATGGATTGCATCATTTAAGTGTTGATG TATCACCTCCCCAAAACTGTTGGTA | SEQ ID NO: 1844 |
| ATP2B4 | ADXCRPD.10094.C1_at | AGCCATCTTTATACTTAGGGAAGAAAAATTGTTGGGTTCTAGACTTTTTTAATATAAATT TTGTTGATATGGAATTAGGTAAGTTTAAGTGTCTATGTGCATATGTTTTTTATATAAGTT TTCTATTCAGTTTACTGATCCAACTGGCAGTGGGTAAATATGGCATAAGTTAATAACAC TTTTCCCCAAAATGGTGCTTTGGATTTGAAAAGGGTCTGATGGGGAGAAGGAGAACGTAT CATCCTAGCTTCCTCTCTTATAAACCTAGAAAACGGGTAGTAAACTGTGGATAGTCA | SEQ ID NO: 1845 |
| CNN3 | ADXCRPD.1098.C1_s_at | AAGAGCAAATGCATCACCCAGGCCTAAATGTCCACAGGCCACTTTTGTACATGCTCTTTT AGAAACACCACTCTGAAAAGATCTTGTTCGCTAGGTAAGAGAATGAGTACACATATAATC ACAAATGCACACTGATCATGACTTTATTTAAAAATTAGCAAACAATACTGTAGAAACATT GATATGTAAATTTCTAAAATGCTGCATCTTAAATTTAGTTGGCAAAGACCACATTTAGCA ATAAGCATGAGTTTAGTCTTCCATGTAGAAACCAGATA | SEQ ID NO: 1847 |
| NPC1 | ADXCRPD.8331.C1_s_at | GCAATAAATTAACTTTGTACACATTTTTATATAAAAAACAGCAAGTGATTTCAGAATGT TGTAGGCCTCATTAGAGCTTGGTCTCCAAAAATCTGTTTGAAAAAAGCAACATGTTCTTC ACAGTGTTCCCCTAGAAAGGAAGAGATTTAATTGCCAGTTAGATGTGGCATGAAATGAGG GACAAAGAAAGCATCTCGTAGG | SEQ ID NO: 1849 |
| FHL1 | ADXCRAD_BP325154_s_at | GTGATTCCTAGGACTTTTCCTCAAGAGGAAATCTGGATTTCCACCTACCGCTTACCTGAA ATGCAGGATCACCTACTTACTGTATTCTACATTATTATATGACATAGTATAATGAGACAA TATCAAAAGTAAACATGTAATGACAATACATACTAACATTCTTGTAGGAGTGGTTAGAGA AGCTGATGCCTCATTTCTACATTCTGTCATTAGCTATTATCATCTAACGTTTCAGTGTAT CCTTACAGAAATAAAGCAGCA | SEQ ID NO: 1850 |
| ELF4 | ADXCRPD.7745.C1_s_at | TAAGAAATGTCAGCCACGGAAACAACTCTATTATCTGGTGACTTTGGGTAATGTGAATCA GTGCCTGAGGACCTTTGCTGTGTCCTTGGTACAGAACCATCCACTTGACCTAACTACCTC CCCTGGACCGCTCTCGCTCTTCTCTTCTTTGTTAAGCCAACAACTATCACCCTCTCCTAC TCTTCTTCTCCCTGCCCCCTGGAGGGCACTGTGTTTGGTTGTGCAAATGTATTTACTATG CGTGTTTCCAGCAG | SEQ ID NO: 1853 |
| LAMB1 | ADXCRPD.10103.C1_at | GATTTTTCTACTGGTCTCATTGCTGGCCAGTGTCGGTGTAAATTAAATGTGGAAGGAGAA CATTGTGATGTTTGCAAAGAAGGCTTCTATGATTTAAGCAGTGAAGATCCATTTGGTTGT AAATCTTGTGCTTGCAATCCTCTGGGAACAATTCCTGGAGGAAATCCTTGTGATTCCGAG ACAGGTCACTGCTACTGCAAGCGTCTGGTGACAGGACAGCATTGTGACCATGTGCCTGCC AGAGCACCTGGGGCTTAAGCTATGAGTTGGATGGATTCGCCATGTACTCGACC | SEQ ID NO: 1854 |
| COL6A2 | ADXCRPD.10104.C1_at | TTCGTCATCAAACGTGGTCAAACAGGCTGGGTGCCATCGCTAAGGACCCCAAAGTCCGAG ACAGGGACGCGTGTGGGCGTGGTGCAGTACAGCCACGAGGGCACCTTTGAGGGCATCCAG CTGGACGGACGAACGTATCGACTCCC | SEQ ID NO: 1855 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| COL6A2 | ADXCRPD.10104.C1_s_at | GACCCCGGTCTCACGGAGTGTGACGTCATGACCTACGTGAGGGAGACCTGCGGGTGCTGC GACTGTGAGAAGCGCTGTGGCGCCCTGGACGTGGTCTTCGTCATCGACAGCTCCGAGAGC ATTGGGTACACCAACTTCACACTGGAGAAGAACTTCGTCATCAAACGTGGTCAAACAGGC TGGGTGCCATCGCTAAGGACCCCAAAGTCCGAGACAGGGACGCGTGTGGGCGTGGTGCAG TACAGCCACGAGGGCACCTTTGAG | SEQ ID NO: 1856 |
| ADAM9 | ADXCRPD.10109.C1_s_at | ATTTTCATAGAAATTAGGCTGGAGAAAGAAGGAAGAAATGGTTTTCTTAAATACCTACAA AAAGTTACTGTGGTATCTATGAGTTATCATCTTAGCTGTGTTAAAAATGAATTTTTACT ATGGCAGATATGGTATGGATCGTAAAATTTTAAGC | SEQ ID NO: 1857 |
| ADAM9 | ADXCRPD.10110.C1_s_at | TTAAGTGTTTAAGTGTTATTCTGAATTTTCTACCTTAGTTATCATTAATGTAGTTCCTCA TTGAACATGTGATAATCTAATACCTGTGAAAACTGACTAATCAGCTGCCAATAATATCTA ATATTTTTCATCATGCACGNNTTAATAATCATCATACTCTAGAATCTTGTCTGTCACTCA CTACATGAATAAGCAAATATTGTCTTCAAAAGAATGCACAAGAACCACAATTAAGA | SEQ ID NO: 1858 |
| EGFR | ADXCRPD.10120.C1_at | GCTGTGGAGCCCTTAAAGATGCCATTTGGCTTGGCTTCCTTGGGAAAGAAGTCCTGCTGG TAGTCAGGGTTGTCCAGGCTAATTTGGTGGCTGCCTTTCTGGGCCCAGTGGCGAGGGCTG TCGAATGTGCTGTTGACACAGGTGGGCTGGACAGTGTTGAGATACTCGGGGTTGCCCACT GCAGTGCTGTGGGGGTCCTGGTAGTGTGGGTCTCTGCTGGGCGCGGGGTTCAGAGGCTGA TTGTGATAGACAGGATTCTGCACAGAGCCAGCGGCCTT | SEQ ID NO: 1860 |
| EPAS1 | ADXCRPD.10121.C1_at | CGAGCCAGCCATGGGCCACGGAGTTGAGGAGCCACACAGCACCCAGAGCGAGGCTGGGAGCC TGCCTGCCTTCACCGTGCCCCAGGCAGCTGCCCCGGGCAGCACCACCCCCAGTGCCACCA GCAGCAGCAGCAGCTGCTCCACGCCCAATAGCCCTGAAGACTATTACACATCTTTGGATA ACGACCTGAAGATTGAAGTGATTGAGAAGCTCTTCGCCATGGACACAGAGGCCAAGGACC AATGCAGTACCCAGACGGATTTCAATGAGCTGGACTTGGAGACACTGGCGAGCTAG | SEQ ID NO: 1861 |
| GATA6 | ADXCRPD.7794.C1_at | CCGTACACTCCTCTCTGGTTTTCTTCCTCAAAGGAAATTTATGCATGTAATCCACAAGCC GAAGAACCCATGTTTTTCTTTGGAAAAGGCTACGCCCTTTCAGGGTTTCCTTTTCTCGGC TGTGTTGCCTTCCCATCAGAAGCTGTCTCTTGCCCTCCCCATTATGGGATGTGCGAAATG AAGGAAAACAGAGACACTGCTGGGCATTTGTCTCCATGAGTTGATCCAATCAGAAATCTT TGACTTTTCACACATGTGTCCAAAAATGAGTG | SEQ ID NO: 1862 |
| FLNA | ADXCRPD.10169.C1_at | TCAGGCAACCTGACGGAGACCTACGTTCAGGACCGTGGCGATGGCATGTACAAAGTGGAG TACACGCCTTACGAGGAGGGACTGCACTCCGTGGACGTGACCTATGACGGCAGTCCCGTG CCCAGCAGCCCCTTCCAGGTGCCCGTGACCGAGGGCTGCGACCCCTCCCGGGTGCGTGTC CACGGGCCAGGCATCCAAAGTGGCACCACCAAC | SEQ ID NO: 1867 |
| RND3 | ADXCRPD.1153.C1_s_at | CACTCAGTTCTATGTCTTACAAGCACTTTGTCTTGTCTCTGCAAGAAAATTCGATTCCAG TCATTTCCCATAAAATACAGACATTTTACCAACATAATATGCTTTGATTGATGCAGCATT ATGCTTTGGGCAGTATTACAAAATAGCTGGCGAGTGCTTTCTGTATTT | SEQ ID NO: 1868 |
| COL4A2 | ADXCRPD.10175.C1_s_at | GCTATCAAGGGCCTGATGGACCCCGGGGACCCAAGGGAGAAGCCGGAGACCCAGGGCCCC CTGGACTACCTGCCTACTCCCCTCACCCTTCCCTAGCAAAAGGTGCCAGAGGTGACCCGG GATTCCCAGGGGCCCAAGGGGAGCCAGGAAGCCAGGGTGAGCCAGGAGACCCGGGCCTCC CAGGTCCCCCTGGCCTCTCCATCGGAGATGGAGATCAGAGGAGAGGCCTGCCGGGTGAGA TGGGACCCAAGGGCTTCATCGGAGACCCCGGCATC | SEQ ID NO: 1869 |
| LPP | ADXCRPD.9098.C1_at | GCATCCACAGTGAATGGGATCCCATCCAGGCTGCGGTGGCACATCACCGCAGGGTGAAAC AGGTGAGGATGATTAGGCCTTCCCGGTGGCTCGGAGAATCCGCTCCATGATGGGCTTGGA ACACACATTGCACTGCTCCAGAGTATTAATGTAGCAGGGCTCGCAGTATGCTTTCTTTTC CACAGCATAAAATGGCTGCCCTCGGAGCTTGTTGTTGAGATGATGCANGTNAAACAATCC ACGTGGAAGACCTGATCCATGGCAGTGCATTCTGTACCTTTCCCAACTA | SEQ ID NO: 1872 |
| YPEL5 | ADXCRPD.17470.C1_at | TGGAAAAAGACAACCCAGCAGTTCTGTCCCATCTCAGAAAAAGTTTCCAATCAACACCAA TTATGTGGTGACAAATAACTAGGAATGGTGACATCTTTGGGCAAGACTGACAAGGAAGA ATGGGCTCTGGTGCTACGGTTCATCTCCAACAAGAATATGGCACACCGGCCAGCACAAGC CATGCTAACACTGAGCCTTTAGCGCTGGGCACAGATTCAGATCTCTTCTCTGAAGCTAGC AAATCAA | SEQ ID NO: 1874 |
| ZFP36L1 | ADXCRPD.7802.C1_at | TCCTTGAAACTTCCCCAAGTGTCTGCACAACTTACCTTTTCCCGACTTCTCTTCGACACT CGGCTCCCTTCGGCAAACCGGGCAGGCCGAGGACATTAGAAATTTGGGACGCACAGAATG TTCAAGCCTAGGATTTTATGTTGCTGTTTTTTTTCCAGCGGNGCGTAGGGTGGGGCGCGG TGCTGGGGGGACTAGGGAAACTTTTTCCCCAGGAGGACATGGTCTGGCGGGCGCGAGCGC GGCACAATTTAGTGCGTCGCACGCGTCGACACT | SEQ ID NO: 1875 |
| RRBP1 | ADXCRPD.7803.C1_s_at | GAGGCGTTTGACGTTCTAGGTTATCCCTCCGCAAGGGGATTCTCTGCCTGGCTTGCTGAT GTCATATCTGGTGGGGAGTGGATTTAGATCTGACACTTTTTCTGCTCTTCAGAAGCAGAA GCACAAGCCCAGTATCCCAATTCTGGTTTAATCTCAAA | SEQ ID NO: 1876 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| MAP1LC3B | ADXCRPD.17493.C1_at | GAGTCTCATTAGTGTCTGTGTTTACTGAACGCTGCGGACATCTTTTCTATATACAGTAAT TCTTCCACCCTGTCACAACAAAGAGAAGTTGAGTGGCAGGAATGGGAAATCTTTCACTGC TTCTTTGGGAAAGAAAAATGCTTATTTGTACATTGTTCTATTGTGTGAGACCTACATAGG GTTCTGTGTAAGGCCGAGTCAAGCTGTCATCACTTTCCTTGGTAAGTTTGAGAGCTTTAT CTAGCGGACACGTTCTGAAGT | SEQ ID NO: 1877 |
| CAST | ADXCRPD.7890.C1_s_at | AGTTAAGGTATCTGGTATCTGCATGTAAAATCTTCAGCTGGTGGATGGTGACTTTTGAAG AACAAAAGGCTTTGGCAACAGAAAACAATTGTTCTGGGTGATTTCTAGAATGGTTTTTGT TGAGTCTCTGAACATCCTAAATATTGGTTTGTTA | SEQ ID NO: 1879 |
| CAV1 | ADXCRPD.1261.C1_s_at | TCAAGTTCCAAGTTGCTAATACAGCAACAATTTATGAATTGAATTATCTTGGTTGAAAAT AAAAGATCACTTTCTCAGTTTTCATAAGTATTATGTCTCTTCTGAGCTATTTCATCTANN NNNNNNNNNNNNNNNNNNNNNNNNNNNNNNNNNNNNNNNNNNNNNNNNNNNNNNTTTGCA TGTGGATCAACCATCGCTTTATT | SEQ ID NO: 1881 |
| CD59 | ADXCRPD.18131.C1_s_at | GGCAAGCTCTTCACTATGACAGTAAAGGCTCTCTGCCTGCTGCCAAAGCCTGTGACTTTC TAACCTGGCCTCACGCTGGGTAAGCTTAAGGTAGAGGTGCAGGATTAGCAAGCCCACCTG GCTACCAGGCCGACAGCTACATCCTCCAACTGAACCTGATCAACGAAGAGGGATTCATGT GTCTGTCTCAGTTGGTTCCAAATGAAACCAGGGAGCAGG | SEQ ID NO: 1883 |
| CORO1C | ADXCRPD.18147.C1_at | GATATCCAAATAGCTTTATTGGCAAGAATCCACCTCTAGGATGTCCTTCCCGTATTTTGC TTCATCCTTGAAACTAACATCCTAGGAGCAACACATGCTGCCTCTTTTTAAAGGGGCCTG GAGGCGTGGGGCAGACCCTTGAAGGAAGGAAGGAGTTGGTGAGCTGAGATGGTGAATGAG TTGACATTGTGGGCTATCTTTCAGAATCCGTTTCTGAATCTATGTAGCTACTTGATTACA GTTTGGGCTTCTC | SEQ ID NO: 1886 |
| VCAN | ADXCRPD.18158.C1_at | ATTTCAACGACTTCAAGTCCTTCCTGCTTACACAGCCGAACTAAGACCACCTCACTGGTG GAAGACCAAAGAGGCCATTTGCACCTCAGGCTGCTTTCTGACGCCACAGACCTCCAGCAA GCACAAATATTTCAACCTGCACATTAATAGTAGATATTATTCGAGGTCAGCAGA | SEQ ID NO: 1887 |
| CDC42BPA | ADXCRPD.8518.C1_s_at | AAAGCAAGGGCTTCAACAGCCTTAACCAAATATTATTCCCCATAGCCAGTGGAAAATGGA TGTGACAACCCCAGTCGCAGGCCAGAGTGAGTGAGCCCAGCACGGCGCTCCGACTGGCT TCCTCTCTCAGGTGCTGGATTGTGGGGTTAGTGGCATTTCCAGCTGGATTCCTCCTGTTG TAGTTGCCATAAGGAAATGAGATGCAGAATCAGAAGGATCTATTTCTACAGAATCATTTC ACCAGTTAAGCACATGAGTAGAGA | SEQ ID NO: 1891 |
| FLNB | ADXCRPD.18190.C1_s_at | TGGACTCAAGCTATTGTTCACCTCAGCCTCCCTTTTGTGATTTCTAATTTATTTTTAGTA ATTAACAATGTATTGCTTGTATAAATTTT | SEQ ID NO: 1892 |
| LAMB1 | ADXCRPD.478.C1_at | TTTTAATCACATTTTGTATGGAGTTAAATAAAGTACAGTGCTTTTGTA | SEQ ID NO: 1896 |
| LAMB1 | ADXCRAD_CN388541_s_at | ATGCCAGAAGGAAAGCCGAAATGCTACAAAATGAAGCAAAAACTCTTTTAGCTCAAGCAA ATAGCAAGCTGCAACTGCTCAAAGATTTAGAAAGAAAATATGAAGACAATCAAAGATACT TAGAAGATAAAGCTCAAGAATTAGCAAGACTGGAAGGAGAAGTCCGTTCACTCCTAAAGG ATAAGCCAGAAAGTTGCTGTGTATAGCACATGCTTGTAACAGAGGAGAATAAAAAATG GCTGAGGTGACCAAGGTAAAACA | SEQ ID NO: 1897 |
| KDELR2 | ADXCRPD.491.C1_s_at | AAGGTCTGGAAGCTCTGTGTAGCCATTCCTTCTGCAGTCATCCTACCCAAGTAAAAGTAA CCTTGGCTATGTTACCACCGTTTTGGTCACCCAGGAGGACATCTTAGCAAGGGTGCCTGC GAGGGAGTGTGGGACTGGGCCTCATCCTCGCCGGCGTTGGAAACCAAGGCCTTGTATGCC ACGCCTTATGAAGCACTGTTTCACAGTTACTTTCACTTCCCGAA | SEQ ID NO: 1898 |
| SCRN1 | ADXCRPD.2301.C1_at | CACGTGCTTCCTTACTAAGGCTGAGAGCTCAACTGAAGACCTTCCCCAATAAATGACAGA TGGCTCTTCAGTCAGGAATGCAGTTAGTGTTTCATGACAGACATCCTGGTCCCACCTGG CTTCCCTGCTGAACCACCCAGTACTGAATAACACCTGTACCAATGTGGGATGACATCAGC TAGGAAGCAAAGTAATTTGCCTGGTTGATGATTATTTTTTATACCTAATGATTCACCCAA TAGTAAAGGAACCCCACAGCTAAGATC | SEQ ID NO: 1899 |
| CAPN2 | ADXCRPD.6630.C1_s_at | TGCGCTTGATCAACTGAACCAGTATGCCAAAACCAGGCATCCAATTTGTAAACCAATTAT GATAAAGGACAAAATAAGCTGTTTGCCACCTCAAAACTTTATGAACTTCACCACCACTAG TGTCTGTCCATGGAGTTAGAGGGGACATCACTTAGAAGTTCTTATAGAAAGGACACAAGT TTGTTTCCTGGCTTTACCTTGGGAAATGCTAGCAACATTATAGAAATTTTGCCTTGTTG CCTTATCTTCTTCCAAATGTACTGTTAA | SEQ ID NO: 1900 |
| FLNA | ADXCRPD.3150.C3_at | CTCATGGGTCTTGCCCGATGGGCTGGTCACCTGGGCTGTCATATCCTGGATGCTAATTTC AGGGATTTTCAGGCTGAGGTCACAATGACTACCAACGTTGGCCACTGAAGGAGCCCGACG CCTGCGGGTGATGCTCTCTTTCACCCGGCCCTCGCCTGTCACCTTCACAGAGAAGGGGCT GCCAGGCACGTGCTGGTCGGCAAACTTGATGTTGATGATGTAGTTGCCTGGCTCTGTGGG GCAGTAGGTGACCCTGCACGTCC | SEQ ID NO: 1902 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| SEPT7 | ADXCRPD.177.C1_s_at | ATAAAGGACCGTTTACCTCTTGCTGTGGTAGGTAGTAATACTATCATTGAAGTTAATGGC AAAAGGGTCAGAGGAAGGCAGTATCCTTGGGGTGTTGCTGAAGTTGAAAATGGTGAACAT TGTGATTTTACAATCCTAAGAAATATGTTGATAAGAACACACATGCAGGACTTGAAAGAT GTTACTAATAATGTCCACTATGAGAACT | SEQ ID NO: 1905 |
| RAB32 | ADXCRPD.4345.C1_at | TTTGTCATTGTTGCCATCATATGGAAGATAATGTTTACATCCTTTTAAACATTTTTATAT GACAATTCCTCAGGATTTGGTAAGGCTTCCAAGTTGTAGCTT | SEQ ID NO: 1906 |
| RAB32 | ADXCRPD.4345.C1_s_at | ATGTCATGTTAGCTGGGAGTCTTCCCACATGTGGCACTTCAAAAGGCAGCACCACTGGGC GCCTGCACTTATTTGAAAATGGAACTTTGGGAGAAGTATCCCTGCTAGTGGCTCTGTAAC TTAACAGATGACAATTAGGCTTTT | SEQ ID NO: 1907 |
| MARCKS | ADXCRPD.2741.C1_at | GGGTCTCCTCTCTCGGGCGGCTACTACTCCACACCGAGAGGGAGTGTCTTACAAGGCGGC CGGCGTGCAAACAAAAAAATAATATAACCGNNNNNNNNNNNNTCGGTCGCACCTATATTCG AGCAAAGAAAAGCGTGGGTGGTAAAGTATATTCTATAAACACAATTTCCTCGCGCCCACC ACGGTGGAATACCCACTCCCCATAAAACGGCCGGTGGGAGAAGACTCTCGAACACCGCCC G | SEQ ID NO: 1908 |
| CD55 | ADXCRPD.1207.C1_at | TTCTATCTGGGCACACGTGTTTCACGTTGACAGGTTTGCTTGGGACGCTAGTAACCATGG GCTTGCTGACTTAGCCAAAGAAGAGTTAAGAAGAAAATACACACAAGTATACAGACTGTT CCTAGTTTCTTAGACTTATCTGCATATTGGATAAAATAAATGCAATTGTGCTCTTC | SEQ ID NO: 1911 |
| LEPRE1 | ADXCRAD_CN309928_s_at | AGACGGATGGGTGACTAGACCCATGGAGAGGAACTCTTCTGCACTCTGAGCTGGCCAGCC CCTCGGGGCTGCAGAGCAGTGAGCCTACATCTGCCACTCAGCCGAGGGGACCCTGCTCAC AGCCTTCTACATGGTGCTACTGCTCTTGGAGTGGACATGACCAGACACCGCACCCCCTGG ATCTGGCTGAGGGCTCAGGACACAGGCCCAGCCACCCCCAGGGGCCTCCACAGGCCGCTG CATAACAGCGATACAGTACTTAAGTGTCTGTGTAGACAACCAAAGAATAA | SEQ ID NO: 1914 |
| LDLR | ADXCRPD.1293.C1_s_at | CCCTGGTTGCTGTATTTGTTCAGTGACTATTCTCGGGGCCCTGTGTAGGGGGTTATTGCC TCTGAAATGCCTCTTCTTTATGTACAAAGATTATTTGCACGAACTGGACTGTGTGCAACG CTTTTTGGGAGAATGATGTCCCCGTTGTATGTATGAGTGGCTTCTGGGAGATGGGTGTCA CTTTTTAAACCACTGTATAGAAGGTTTTTGTAGCCTGAATGTCTTACTGTGATCAAT | SEQ ID NO: 1916 |
| PTRF | ADXCRPD.2246.C1_x_at | TCTCCCCAGTCACAGCCTGAAGGGAGGCCCCGAGAGCTTCCTCCTTCCCCCCACCTGCTC CTTACCTTCTCTGCCCTGCTTTTTAGAACTGCAGTTCATTGTTTTAAGGGATTGGGGGAG GGAGCCTGGGGACACAAACCTTTTATACAATACAAAGCTTTGCNNNNNNNNNNNNNNNNNC TTCCCTTTTCCCNTTTCTCGGTTCTCTTTTCTCTCCTCTGGAATGGGCTGAAGACCCCTC TGCC | SEQ ID NO: 1917 |
| FKBP9 | ADXCRPD.3075.C1_s_at | AGAAGTTTGGGCTGATCGCCAGTGATAGTAAACAAAATCTGTGCAGAGGGCCTTAGCATG GGATGTGTCCAGTATTGAAAAGGCTGCACTGCCAACCATGATTTGTGAGCCTTCTGGGAA ATTTTGTTATTAAAGGAATATATAGTGTCAGACGGAAGTTATAATCATCTTGGAGGAACC ATAAGAAAAGGTGTCCAGGGTATCTATATAAA | SEQ ID NO: 1918 |
| S100A11 | ADXCRPD.77.C3_at | TTCTCACAGGAGTATAAGGTACAGGATAGGGATTATTAATATTCCCATTTGCCAGATGCA GAAACAGACTAAAAGAGGTGAAGTGACCTGCCTAAGGGCCAGACCTGGGCCTTGAACCAA AGGTTTTCCCACTCCTCAGGGCTCTTTCCATGATATAAGGGGCTATTCAGTTTGGT AAAGCCAGTGGAACACTTTCTTTCAAGTGTTGCATGCACTTCCCAATAGATAAACT | SEQ ID NO: 1920 |
| FOXN3 | ADXCRPDRC.8652.C1_s_at | GAGCCTTCACGTAAATGGGTCCAGTCATGCCTCCCAGTAAGAAGCCAGAAAGCTCAGGAA TTAGTGTCTCCAGTGGACTGAGTCAGTGTTACGGGGGCAGCGGTTTCTCCAAGGCCCTTC AGGAAGACGAGTGACCTCGACGTTTTCTCTGCCTGACATCCGATTATAAGAAGGGGGCCA TGGAAGATGAAGAGCTGACCAACCTGAACTGGCTGCACGAGAGCAAGAACTTGCTGAAGA GCTTTG | SEQ ID NO: 1924 |
| LAMB1 | ADXCRPDRC.11010.C1_at | GCCGATGACTGCGACCCAGTGACTGGGGAGTGCTTGAACTGCCAGGACTACACCATGGGT CATAACTGTGAAAGGTGCTTGGCTGGTTACTATGGCGACCCCATCATTGGGTACAGGAGA TCACTGCCGCCCTTGCCCTTGCCCAGATGGTCCCGACAGTCGGACGCCAGTTTGCCCCGG AGCTGCAACCAAGATACCTGTTACTTTACTGCTGCCTGTGTTTGTGATCCTGGATACATT GGTTCCAGATGTGACGATCTGTGCCTACAGG | SEQ ID NO: 1925 |
| FOXN3 | ADXCRPDRC.8765.C1_s_at | AAAGGGTCGTTGTGGTGCATAGACCCAGAGTATAGACAAAATCTAATTCAGGCTTTGAAA AAGACACCTTATCACCCACACCCACACGTGTTCAATACACCTCCCACCTGTCCTCAGGCA TATCAAAGCACATCAGGTCCACCCATCTGG | SEQ ID NO: 1928 |
| ARID5B | ADXCRPDRC.11117.C1_at | GATTTTTGTGGGACAACTCTAGCCCACAAACTGACTGGCTGGTGAGTCTTGACTCCCTTC CAACACAGATGCCCAGGCACCTCCAGATCATTCACTTCGCACGTGGGCCTTGTGAAGGGA TTTGTGAATATCCAGGAAGAACTTAGAGGGACCCCATCTGAGTTCGGATGGTCAGGAAACA ATCTGGGCAAAAAGAGGCAGGCATTTCAAAGGAAGGGGCAAGGAAGACTGGCAAACAGA TGGCAAGGC | SEQ ID NO: 1931 |
| KDELR3 | ADXCRPDRC.11126.C1_at | GACCTTTTCATCAATAGATCGCCCTTAAAGACCCATTGTAAGGTCATAAAAAACCTCGGC CAACTGCACAAAGATGGTGCCTCACTGCAACAAGAAACCTTAAGGTGTCTTACCGACGAA | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | ATAAAAAACATAAATGATTGTTCTCCAAGGCCTGAGGGCAAGACTCATGATGGGCAAGTC AACCCCAATCTGGAACAATGTCCCTCCTCTTAG | 1932 |
| LEPROT | ADXCRPDRC.1565.C1_s_at | CTGAAGCCCCACTCTGGACCCAGGACATTTTGATGAGATCCAAAGGAGTTGTATGCACAT GAAAGTTTGAGAAGCATCATCATAGAGAAGTAAACATCACACCCAACTTCCTTATCTTTC CAGTGGCTAAACCACTTAACCTCTCTGGGTGTTACCTGCTCATTTGTTT | SEQ ID NO: 1933 |
| MALT1 | ADXCRPDRC.2292.C1_at | GGGTGATGCCCTACGTTTACTGAATTTTCCACTTGGATCCTAGATATTGGATCCCAAAAG ATGGCAAATTAAAGGGCACACCCTGAAAGAAACCTGGGAAGCTAACTTGGGTATTCCAAA GGAATTTTTCCCCAAGGCATTTGCCCTTCTATACCCAAGACTTCAGGTTCCCCTGGCAAA | SEQ ID NO: 1935 |
| SYNJ2 | ADXCRPDRC.17920.C1_at | TAAGAGAATTCCCGCCAAAGGGCCAAAATTGGCCTGGGTAAACTTTTGCAGGAACGGTCA CTCGGCTCTCA | SEQ ID NO: 1936 |
| SYNJ2 | ADXCRPDRC.17920.C1_s_at | GTCACTCGGCTCTCAGTGTCCTGGACGTGGACGGTATGAAGGTGAAAGGCAGAGCAGTGA AGATTAGACCGAAGACCAAGGACTGGCTGAAAGGTTTGCGAGAGGAGATCATTCGGAAAC GAGACAGCATGGCCCCCGTGTCTCCCACTGCCAACTCCTGTTTGCTGGAGGAAAACTTTG ACTTCACAAGTTTGGACTATGAGTCA | SEQ ID NO: 1937 |
| POFUT2 | ADXCRPDRC.17928.C1_at | AATGCTGGAAGTGGCCCCAGCATCCTTCCGCCANNNNNNNNNNNNNNNNNNNNNNNNNNN NNNNNNNNNNNNNNNNNNNNNNNNNNNNNGCAGGACAGCTCATTTTATATTATCAAAT CCCGTTCTTTTAACACGCGACAGTCGCGCAGTTTAATCTTCCCTCCCCCCCTATGCCTCG CCCATTGCCCGTTGGCGGTTATACGCAGTATCCTGATAACGTAGTACCCGCGC | SEQ ID NO: 1938 |
| EPAS1 | ADXCRPDRC.3002.C1_at | TGAACGTGCCCGTGCTTGGGAAGCTGCACGCTCCTGCAAGGAGGGGACCTCTTTCAGAGC TCCTGGACCAGGACACTTGAGCCAGGCCTTCTACCTGGCATCA | SEQ ID NO: 1941 |
| EPAS1 | ADXCRPDRC.3002.C1_x_at | GAACAGCAAGAGCAGGTTCCCGCCACTGTGCTACGCCACCCAGTACCAGGACTACAGCCT GTCGTCTGCCCACAAGGTGTCAGGCATGGCAAGCCGGCTGCTCGGGCCCTCATTTGAGTC CTACCTGCTGCCCGAACTGACCAGATATGACTGTGAGGTGAACGTGCCCGTGCTTGGGAA GCTGCACGCTCCTGCAAGGAGGGGACCTCTTTCAGAGCTCCTGGACCAGGACACTTGAGC CAGGCCTTCTACCTGGCATCA | SEQ ID NO: 1942 |
| ALCAM | ADXCRPDRC.1829.C1_s_at | TTCTAGGTATAGAACTATGTTATTGAAAGGAAAAGGAAAACTGGTGTTTGTTTCTTAGAC TCATGAAATAAAAAATTATGAAGGCAATGAAAAATAAATTGAAAATTAAAGTCAGATGAG AATAGGAATAATACTTTGCCACTTCTGCATTATTTAGAAACATACGTTATTGTACATTTG TAAACCATTTACTGTCTGGGCAATAGTGACTCCGTTTAATAAAAGCTTCCGTAGTGCATT GGTATGGATTAAATGCATAAAATATTCTTAGACTCGATGCTGTATAAAATATTA | SEQ ID NO: 1947 |
| ARID5B | ADXCRPDRC.10890.C1_at | TTATACTTTTGTAGACTCTCCTGTGTTGTCCATATTGTATACTTTTGGTGATTCCAGCTA TTTAACCTCTATGTCTCTGCTAAGGTGATTATTTGTATATAGCACTCGGCCCTGTGATAT TATAGAGTTTCCCGTGGAGA | SEQ ID NO: 1948 |
| FOXN3 | ADXCRPDRC.12156.C1_at | GTGAACGATCATTTCTGACTTAACCGTGAGATGCTCACGAGTACCCTTCCTGTTGTTTTG TTAGCATTGAAATCGAGACTATTTATTTGGAATATATACAACAGTGTTTTTCCACTGTAT TTCATTTGCAAAAGTTGAGAACTGCTTTCTCTACCCTTTGCCAAATTAATGAATATCCAA TATGGGATTTTCAAAGACTCCGATATGGTGAACCTATTAAACCTAGAAATTGTATTCATC CTTTCATGACTGTGGCCTGAGTTCCCCAG | SEQ ID NO: 1953 |
| AHNAK | ADXCRPDRC.3149.C1_s_at | TCCTGGCAAGGCATTCGCTCCTGAGCGGAATCCTGCAAAGATGGAGAAGGAGGAGACAAC CCGGGAGCTGCTGCTGCCCAACTGGCAGGGTAGTGGCTCCCACGGGCTGACCATCGCCCA GAGGGACGACTGTGTGTTTGTGCAGGAGGTGACGCAGAACTCCCCTGCGGCCCGCACTGG GGTGGTCAAGGAGGGGGACCAGATTGTGGGTGCCACCATCTACTTTGACAAGCTGCAGTC GGGTGAGGTGACCCAGCTGCTGAACACCATGG | SEQ ID NO: 1954 |
| ADAM9 | ADXCRPDRC.11545.C1_at | AAAAGCCAAGTGTGCCCCAAAGATTGTTCCATGGAAGTGACATTCTACACAGGTGACAGA TTTGG | SEQ ID NO: 1955 |
| ADAM9 | ADXCRPDRC.11545.C1_x_at | GCTCAATGTCAAGTCATCTTTGGCACAAAAGCCAAGTGTGCCCCAAAGATTGTTCCATGG AAGTGACATTCTACACAGGTGACAGATTTGGCAATTGTGGTTACTCTGGCCATGAATACA AGAAGTGTGCCACTGGGAATAGCTTTGTGTGGAAAGCTTCAGTGTGAGAATGTACAAGAG ATACCTGTATTTGGCATTGTGCCTGCTATTATTCAACACGCCTAGTCGAGGCACCCAATG TTGGG | SEQ ID NO: 1956 |
| FLNA | ADXCRPDRC.3227.C1_at | AGAAGACAGGTGTGGCCGTCAACAAGCCAGCAGAGTTCACAGTGGATGCCAAGCACGGTG GCAAGGCCCCACTTCGGGTCCAAGTCCAGGACAATGAAGGCTGCCCTGTGGAGGCGTTGG TCAAGGACAACGGCAATGGCACTTACAGCTGCTCCTACGTGCCCAGGAAGCCGGTGAAGC ACACAGCCATGGTGTCCTGGGGAGGCGTCAGCATCCCCAACAGCCCCTTCAGGGTGAATG TGGGAGCTGGCAGACACCCCAACAAGGTCAAAGTAT | SEQ ID NO: 1960 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| SVIL | ADXCRPDRC.9920.C1_at | CATGTCTATAAAGAAAGATGGCACTGTTGAAGAAAAGCGGGGAGGAAGATTGGAGAAACA GACTCAGCAGGAGGCAGGAGGGCGGCAGCGCCGCCACAGCCGCACACCCAGAAGCAGGCG TCCCTCATCAGAAGCGT | SEQ ID NO: 1963 |
| SVIL | ADXCRPDRC.9920.C1_s_at | TGGAAGCCCCAGGATTCTTCGGAACAGCCGCAGGAGAAGCTCTGCAAGAATCCATGTGCG ATGTTTGCTGCTGGAGAGATCAAACGCCGACAGGGGAGGGCCTTCTTGACTCACCCAGCA A | SEQ ID NO: 1964 |
| CAPN2 | ADXCRPDRC.9976.C1_at | ACGCGTACTCGGTCACCGGAGCCGAGGAGGTTGAAAGTAACGGAAGCCTACAGAAACTGA TCCGCATCCGAAATCCCTGGGGAGAAGTGGAGTGGACAGGGCGGTGGAATGACAACTGCC CAAGCTGGAACACTATAGACCCAGAGGAGGGGAAAGGCTGACCAGACGGCATGAAGATG GAGAATTCTGGATGTCTTTCAGTGACTTCCTGAGGCACTATTCCCGCCTGGAGATCTGTA ACCTGCCGAAGACCCAGCTTGAG | SEQ ID NO: 1965 |
| CORO1C | ADXCRPDRC.2786.C1_s_at | AATCAAAGCAGTAGCCACATGGTGCTGGCTCCTTTGCAGCACAAACCTGGTCATTTTGAT GACTGTACAACAGGAAGACTTGAAAAATCACGTGGATTCATATTACCACCGCTCTCATTT CATGGAGTCTTCTGATCAAAAAGCTCACGTCGTATTTCTTCTTTTCCTTTCTCTTTTCT AGAAATTGGGTGTTTGTACCAGAATGGAATTTTGCTTCTCGGTTATCCTGTGCTTCAGAT GAT | SEQ ID NO: 1966 |
| IL6ST | ADXCRPDRC.11859.C1_s_at | ACACTTCGAGCACTGTCCAGTATTCTACCGTGGTACACAGTGGCTACAGACACCAAGTTC CGTCAGTCCAAGTCTTCTCAAGATCCGAGTCTACCCAGCCCTTGTTAGATTCAGAGGAGT GGCCAGAAGATCTACAATTAGTAGATCATGTAGATGGCGGTGATGGTATTTTTCCCAGGC AACAGTACTTCAAACAGTACTGCAGTCAGCATGAATCCAGTCCAGATATTTCACATTTTG AAAGGTCAAAGCAAGTTTCATCAGTCAATGAGG | SEQ ID NO: 1971 |
| ADAMTS1 | ADXCRPDRC.13363.C1_at | AAAGGCATTGGCTACTTCTTCGTTTTGCAGCCCAAGGTTGTAGATGGTACTCCATGTAGC CCAGATTCCACCTCTGTCTGTGTGCAAGGACAGTGTGTAAAAGCTGGTTGTGATCGCATC ATAGACTCCAAAAAGAAGTTTGATAAATGTGGTGTTTGCGGGGGAAATGGATCTACTTGT AAAAAAATGATCAGGATCAGTTACTAGTGCGAAACCTGGATATCATGATATCATCACAAT TCCAACTGGAGCCACCAACATCGAAGTG | SEQ ID NO: 1975 |
| SPTBN1 | ADXCRPDRC.13403.C1_at | CAGTACATGTTTCTGCGGCAGCGGCTGCAGGCTCTGGACACTGGATGGAACGAGCTCCAC AAGATGTGGGAGAACAGACAAAATCTCCTATCCCAGTCACATGCCTACCAGCAGTTCCTC AGAGACACGAAGCAAGCCGAAGCCTTTCTTAACAACCAGGTAAGGTTTGTTCCTGCCTTT GCTTCCTTTCGGTGAAAGCAGCGCTGGCTGCCTTTTGAAATGTTTTGGCTGGGGCAGCTG GTTTAAACCACACCCTGTATGGAATATATGGATAATTTAGAGACCGCGATG | SEQ ID NO: 1979 |
| PTPRK | ADXCRPDRC.14082.C1_s_at | GGATTCACGGGTAGAGATTGGCTTCGGGCTGAGCTAGCAGTGAGCACCTTTTGGCCCAAT GAATATCAGGTAATATTTGAAGCTGAAGTCTCAGGAGGGAGAAGTGGTTATATTGCCATT GATGACATCCAAGTACTGAGTTATCCTTGTGATAAATCTCCTCATTTCCTCCCGTCTAGG GGATGTAGAGGTGAATGCAGGGCAAAACGCTACATTTCAGTGCATTGCCACAGGGAGAGA TG | SEQ ID NO: 1980 |
| MARCKS | ADXCRPDRC.4423.C1_s_at | CGTTACACCAACCCGAGGCTCTTTGTTTCCCCTCTTGGATCTGTTGAGTTTCTTTGTTGA AGAAGCCAGCATGGGTGCCCAGTTCTCCAAGACCGCAGCGAAGGGAGAAGCCGCCGCGGA GAGGCCTGGGGAGGCGGCTGTGGCCTCGTCGCCTTCCAAAGCGAACGGACAGGAGAATGG CCACGTGAAGGTAAACGGCGAC | SEQ ID NO: 1981 |
| ARID5B | ADXCRPDRC.12803.C1_at | ACCACCTGGCAATACAGTCCACTTTCTGGTTTCTTTTATTGTGGGAAGTAAATGGTCAAG CTGCTCAGGCAGTGAAAAGATGTGGAGAATGTCCGTTGTCATTCTTGCCACTGTATTCCA TTTGCTACCGAGATATAACATTAAGGTGGACACATTTTCTAACTGTATTAATTAAAGTC AATGGATACAGAGAGTGGATTTTCTCCCCAAGTCCCATCCCTGCTGAAGACCGCTTGGAT GACTCCCCAACCCACTGTGCCCCTCCCGCAACACTACCAGTAACAACAACGCG | SEQ ID NO: 1985 |
| SGCE | ADXCRPDRC.12912.C1_at | TATTAAGTGTATACCCTATAATCGACATTCTC | SEQ ID NO: 1991 |
| SGCE | ADXCRPDRC.12912.C1_s_at | TCCACCCTGTGACTGGGAAATCATTACCTCCTTTACACACTAGACAACTATGATAGCAC TAACATGCCATTGATGCAAACGCAGCAGAACTTGCCACATCAGACT | SEQ ID NO: 1992 |
| SGCE | ADXCRPDRC.12912.C1_x_at | GGGAAATCATTACCTCCTTTACACACTAGACAACTATGATAGCACTAACATGCCATTGAT GCAAACGCAGCAGAACTTGCCACATCAGACTCAGATTCCCCAACAGCAGACTTACAGGTA AATGGTATCCCTGAAGAAAGAAAACTGACTGAAGCAATGAATTTATAATCAGACTCATAT AGCAGTTACATCACATTTCTTTTCTCTTCCTATAATGCATGAGCTTTTCTGTCATATGTT ATGCATGTTGCAGTATTAAGTGTATACCCTATAATCGACATTCTC | SEQ ID NO: 1993 |
| FNDC3B | ADXCRPDRC.13581.C1_at | TTTATTCAAATCCAATAGCAAGCTCTGTTTTCTAATATAGTAAATGTCTTTATAGTAATA GTGAGTAATCATCAATTCTAAAGATAGAATTATTATTACAATAAACAAACTTTAGTCACA TATTGGCAGTTT | SEQ ID NO: 1994 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FNDC3B | ADXCRPDRC.13581.C1_s_at | TGGCTTTAGTGTCAAATGGGATCCCCCTAAGGACAATGGTGGTTCAGAAATCCTCAAGTA CTTGCTAGAGATTACTGATGGAAATTCTG | SEQ ID NO: 1995 |
| LOXL2 | ADXCRPDRC.4590.C1_s_at | ACCGTCTGCGACGACAAGTGGGACCTGGTGTCGGCCAGTGTGGTCTGCAGAGAGCTGGGC TTTGGGAGTGCCAAAGAGGCAGTCACTGGCTCCCGACTGGGGCAAGGGATCGGACCCATC CACCTCAACGAGATCCAGTGCACAGGCAATGAGAAGTCCATTATAGACTGCAAGTTCAAT GCCGAGTCTCAGGGCTGCAACCACGAGGAGGATGCTGGTGTGAGATGCAACACCCCTGCC AT | SEQ ID NO: 1997 |
| GJA1 | ADXCRPDRC.13657.C1_at | GCCTATGTCTCCTCCTGGGTACAAGCTGGTTACTGGCGACAGAAACAATTCTTCTTGCCG CAATTACAACAAGCAAGCAAGTGAGCAAAACTGGGCTAATTACAGTGCAGAACAAAATCG AATGGGGCAGGCGGGAAGCACCATCTCTAACTCCCATGCACAGCCTTTTGATTTCCCCGA TGATAACCAGAATTCTAAAAAAACTAGCTGCTGGACATGAATTACAGCCACTAGCCACTT GTGGACCAGCGCCTTTCACAGTTCGTAGGGAT | SEQ ID NO: 2000 |
| SPTBN1 | ADXCRPDRC.15064.C1_at | CTGCAGTTGAGTCCGCCACAAAAAGCACGAGGCCATTGAGACAGACATTGCCGCATACG AGGAGCGTGTGCAGGCTGTGGTAGCCGTGGCCAGTTAGCTCGAGGCCGATAATTACCACG ACATCAAGCGCATCACAGCGAGGAAGGACAATGTCATCCGGCTCTGGGAATACCTACTGG ACCTGCTCAGGGCCCGGAGACAGCGGCTCGAGATGAACCTGGGGCTGCAGAAGATATTCC AGGAAATGCTCTCCTTATGTGCTA | SEQ ID NO: 2002 |
| LAMB1 | ADXCRPDRC.14422.C1_at | GTCAGCCTTGCCAGTGTCACAACAACATTGACACGACAGACCCAGAAGCCTGTGACAAGG AGACTGGGAGGTGTCTCAAGTGCCTGTACCACACGGAAGGGGAACACTGTCAGTTCTGCC CGGTTTGGATACTATGGTGATGCCCTCCGGCAGGACTGTCGAAAGTGTGTCTGTAATTAC CTGGGCACCGTGCAAGAGCACTGTAACGGCTCTGACTGCCAGTGCGACAAAGCCCACTGG TCAGTGCTTGTGTCTTCCTAATGTGATCGGGCAGAAACTGTGACCGCTGTGTATTC | SEQ ID NO: 2003 |
| TGFBR2 | ADXCRPDRC.13821.C1_s_at | ATGCCAGCCTTCTCAACCTTTGCAGAAATTACTAGAGAGGATTTGA | SEQ ID NO: 2005 |
| TGFBR2 | ADXCRPDRC.13821.C1_x_at | CAGCCTTCTCAACCTTTGCAGAAATTACTAGAGAGGATTTGAATGTGGGACACAAAGGTC CCATTTTGCACGTTAGAAAATTTGTGTCCACAAGGACAAGAACAAAGTANTGAGCTTTAA AGCTCCATAGGAAACTTGTTAAATCAACAAGAGAAGTGTTAATGCTGCAAGTANTCCTCN NNNNNNNNNNNNNNNNNNNNNNNNNNNNNNNNNNNCAAGCCAAAATAGGAATATTAAGAN GAGGGGACTGGGTANGTGAGAATATCAGCTCCGGTTTGGGATGGTG | SEQ ID NO: 2006 |
| FAM50A | ADXCRPDRC.6370.C1_at | ACTGCTGCATGGTGTTGCCCTTTCTCATCTTGACTGTCCGCCGGTGCCCAGAGCCATCCC AGTAGCTGAAGGTGATCTCGATCTCCTCACTCTTGATCTTCTCCTGCTTGGCTTCCCACT CCTGCCGCAGCTCTTCCCGAAGCCGATTCTCCTCCTCCTCACGGTCTCGATCAGGCAAGA AGCTTGTGTCAACGTCTGGGT | SEQ ID NO: 2010 |
| CD59 | ADXCRPDRC.15392.C1_at | ATCTTTCCCCTTGCGGTACTAATCTATTGGCGCACAAGGAGGGCGTCACAGTGCT | SEQ ID NO: 2011 |
| CD59 | ADXCRPDRC.15392.C1_s_at | GTAGTGAGCTGCCTTTCTGTGATCGGTTTCCCTAGGGATGTTGCTGTTCCCCTCCTTGCT ATTCGCAGCTACATACAACGTGGCCAACCCCAGTAGGCTGATCCTATATATGATCAGTGC TGGTGCTGACTCTCAATAGCCCCAC | SEQ ID NO: 2012 |
| CCND1 | ADXCRPDRC.16054.C1_at | GTAGTGACCTGTTTATGAGATGCTGGTTTTCTACCCAACGGCCCTGCAACCAGCTCACGT CCAGGTTCAACCCACAGCTACTTGGTTTGTGTTCTTCTTCATATTCTAAAACCATTCCAT TTCCAAGCACTTTCAGTCCAATAGGTGTAGGAAATAGCGCTGTTTTTGTTGTGTGTGCAG GGAGGGCAGTTTTCTAATGGAATGGTTTGGGAATATCCATGTACTTGTTTGCAAGCAGGA CTTTGAGGCAAGTG | SEQ ID NO: 2013 |
| PPP4R1 | ADXCRPDRC.6469.C1_s_at | GAATATCTTTATCAACTTCAGGAGTTTTTGGTGACAGATAATAGTAGAAATTGGCGGTTT CGAGCTGAACTGGCTGAACAGCTGATTTTACTTCTAGAGTTATATAGTCCCAGAGATGTT TATGACTATTTACGTCCCATTGCTCTGAATCTGTGTGCCGACAAAGTTCTTCTGTTCGT TGGATTTCCTACAAGTTGGTCAGCGAGATGGTGAAGAAGCTGCACGCGGCAACACCACCA ACGTTCGGAGTGGACCTCATC | SEQ ID NO: 2014 |
| CRIM1 | ADXCRPDRC.15616.C1_s_at | AGTGCAGACCCATAATCTGTGACAAGTATTGTCCACTTGGATTGCTGAAGAATAAGCACG GCTGTGACATCTGTCGCTGTAAGAAATGTCCAGAGCTCTCATGCAGTAAGATCTGCCCCT TGGGTTTCCAGCAGGACAGTCACGGCTGTCTTATCTGCAAGTGCAGAGAGGCCTCTGCTT CAGCTGNGCCACCCATCCTGTCGGACACTTGTCTCACCGTGGATGGTCATCATCATAAAA ATGAGGAGAGCTGGCACGATGNGTGCCGNGAATGCTACTGTCAATGGACGGG | SEQ ID NO: 2018 |
| FLNB | ADXCRPDRC.15647.C1_at | CGAACTCAACCCGAAAGAAGCCAGGGCCTATGGCAGAGGAATCGAGCCCACTGGAAACAT GGTGAAGCAGCCAGCCAAGTTCACTGTGGACACCATCAGCGCCGGGCAAGGAGACGTGAT GGTGTTTGTTGAGGACCCAGAAGGGAACAAAGAGGAGGCACGAGTGACCCCTGACAGTGA CAAGAACAAGACATACTCTGTGGAGTATCTGCCCAAGGTCACCGGGCTACTACAAAGTCA CAGTCCTCTTGCAGGACAGCACATCTCCGAA | SEQ ID NO: 2019 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| IGFBP3 | ADXCRPDRC.17075.C1_at | TTTTCTTGTCGGCTTCCTATCAGAATATTCAGAG | SEQ ID NO: 2020 |
| IGFBP3 | ADXCRPDRC.17075.C1_s_at | TTGAATGGTAAACTTGAGCATCTTTTCACTTTCCAGTAGTCAGCAAAGAGCAGTTTGAATTTTCTTGTCGGCTTCCTATCAGAATATTCAGAGACTCGAGCACAGCACCCAGACTTCATGCGCCCGTGGAATGCTCACCACATGTTGGTCGAAGCGGCCGACCACTGACTTTGTGACTTAGGCGGCTGTGTTGCCTATGTAGA | SEQ ID NO: 2021 |
| CASK | ADXCRPDRC.17222.C1_at | TTGAAATCGTAAAGCGAGCTGACGCTGGTTTTGTGTACAGTGAAGCTGTAGCCAGCCATTATATGAGACAGATACTGGAAGCTCTACGCTACTGCCATGATAATAACATAATTCACAGGGATGTGAAGCCCCACTGTGTTCTCCTTGCCTCAAAAGAAAACTCGGCACCTGTTAAACTTGGAGGCTTTGGGTAGCTATTCATTAGGGGAGTCTGGACTTGTAGCTGGGAGACGTGTTGGAACACC | SEQ ID NO: 2029 |
| SYNJ2 | ADXCRPDRC.8240.C1_at | TCGGCTTCACTCTTGACAGCGCTTGCTTTGTATTTCCTGGGTTGCTCTTCTGTCCCACATTGGCTCATTGCCATCTGTCCCTTGTCCATGCTTCCTTACAAAGTGGACCTTTTTCCTCCGCCTCTTCCCTGTTCAGATGCTCCTCGACTTAAAATGGGGTTACATCCCAATAAACCCATCGTAAGTTGAAAAATAGCGTGTCAAAACTGCATCTCATACACCTAACCTAGCAAACGTCATGGTCTCGCTGACCTTGAACACACTCAGAACACATACATTAGCCTACGGCT | SEQ ID NO: 2030 |
| MARCKS | ADXCRPDRC.8271.C1_s_at | GAAGGCGAGGCTGCCGAGCCCGGCTCGCCCACGGCCGCGAGGGAGAGGCCGCGTCGGCCGCCTCCTCGACTTCTTCGCCCAAGGCCGAGGACGGGGCCACGCCCTCGCCCAGCAACGAGACCCCGNNNNNNNNNNNNGAAGCGCTTTTCCTTCAAGAAGTCTTTCAAGCTGAGCGGCTTCTCCTTCAAGAAGAACAAGAAGGAGGCTGGAGAAGGCGGTGAGGCTGAGGCGCCC | SEQ ID NO: 2032 |
| TMEM158 | ADXCRPDRC.7689.C1_s_at | GATTAAATTGCTATTGCTGTAGTAAGAGAAGCTCTTTGTATCTGAACATAGTTGTATTTGAAATTTGTGGTTTTTAATTTATTTAAAATTGGGGGAGGGCATGGGAAGGATTTAACACCGATATATTGTTACCGCTGAAAATGAACTTTATGAACCTTTTCCAAGTTGATCTATCCAGTGACGTGGCCTGGTGGGCGTTTCTTCTTGTACT | SEQ ID NO: 2034 |
| FHL1 | ADXCRPDRC.10038.C1_at | AGTATTACTCAAATAAGGGCACACAGTGATCATATTAGCATTTAGCAAAAAGCAACCCTGCAGCAAAGTGAATTTCTGTCCGGCTGCAATTTAAAAATGAAAACTTAGGTAGATTGACTCTTCTGCATGTTTCTCATAGAGCAGAAAAGTGCTAATCATTTAGCCACTTAGTGATGTAAGCAAGAAGCATAGGAGATAAAACCCCCACTGAGATGCCTCTCATGCCTCAGCTGGGACCCAGCTTGAGACCCGCGA | SEQ ID NO: 2035 |
| EGFR | ADXCRAD_CV574329_s_at | GGAAGCCAAGCCAAATGGCATCTTTAAGGGCTCCACAGCTGAAAATGCAGAATACCTAAGGGTCGCGCCACAAAGCAGTGAATTTATTGGAGCATGCACACGGAGGATAGTATGAGCCCTAAAAATCCAGACTCTTTCGATACCCAGGACCAAGCCACACAGGTCCTCCATCCCAACAGCCATGCCCGCATTAGCTCTTAGACCCACAGACTGGTTTTGCAACGTTTACACCGACTAGCCAGGAAGTACTTCCACCTCGGGCACATTT | SEQ ID NO: 2037 |
| LPP | ADXCRPDRC.9098.C1_s_at | AGGAGACTGTCCGTATTGTGGCTTTGGATCGAGATTTCCATGTTCACTGCTACCGATGCGAGGATTGCGGTGGTCTCCTGTCTGAAGGAGATAACCAAGGCTGCTACCCCTTGGATGGGCACATCCTCTGCAAGACCTGCAACTCTGCCCGCATCAGGGTGTTGACCGCCAAGGCGAGCACTGACCTTTAGATTCAGTCACCTGTTCAGCCG | SEQ ID NO: 2040 |
| YPEL5 | ADXCRPDRC.17470.C1_s_at | GAATCTGTGCCCAGCGCTAAAGGCTCAGTGTTAGCATGGCTTGTGCTGGCCGGTGTGCCATATTCTTGTTGGAGATGAACCGTAGCACCAGAGCCCATTCTTCCTTGTCAGTCTTGGCCCAAAGATGTCACCATTCCTAGTTATTTGTCACCACATAATTGGTGTTGATTGGAAACTTTTTCTGAGATGGGACAGAACTGCTGGGTTGTCTTTTTCCATGTAACT | SEQ ID NO: 2041 |
| ZFP36L1 | ADXCRPDRC.7802.C1_at | GGAAGTTTCAAGGAGACCGCCAGCTCAAGATGGAAACCGCGGCCCGGGCGCTAAGAACGGGCTTCAGCTCCCGCTGGCAAAAAGAGAAAGTCGAGCCCGCCTTCCTGCCCAACAAAAAACAACAACATGACAACAAGAACCCCGGAGGGAGTGGAATGAGTGACGTCACAGCCGCGCTCTGAGGCTGACAAAGGAGGGGCGCGCCCCTCCCGCTCTGCGCCCGCGCGGCCCCGGAGAGGGGGCGCCTGAAGCGCCGGGTAGGGAAGTCAGCCGACTTGAAACTTTTCCTCTT | SEQ ID NO: 2042 |
| JUN | ADXCRPDRC.3805.C1_s_at | AACTTGTGCGCGCAGCCCAAACTAACCTCACGTGAAGTGACGGACTGTTCTATGACTGCAAAGATGGAAACGACCTTCTATGACGATGCCCTCAACGCCTCGTTCCTCCCGTCCGAGAGCGGACCTTATGGCTACAGTAACCCCAAGATCCTGAAA | SEQ ID NO: 2045 |
| SCRN1 | ADXCRAD_CK001870_at | AGATGGAAATGCTATTGGCGGGAATATATAAAAAAAAAGAATCTTCTGTTCTGCATGG | SEQ ID NO: 2046 |
| SCRN1 | ADXCRAD_CK001870_s_at | GAGCAGCAGGTCATGTGCACATGCCGTTGCAGCACAAGCTTATGCTTCCCGTAGCCGTGGCTTTTCATTCTGCACAGTCCCAGGTCCCAGCTCCCCTCTTATGGTTTCTGTCATAATGTGCTTTATCTGATTGACTCCAAACATCCCGAAATGTCACCTGCAGATTTCTCGTGGGAACCAATATGTACATGTT | SEQ ID NO: 2047 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FLNA | ADXCRPDRC.3150.C3_s_at | GTCTCGTCAGCAACCACAGCCTCCACGAGACATCATCAGTGTTTGTAGACTCTCTGACCA AGGCCACCTGTGCCCCACAGCATGGGGCCCCGGGTCCTGGGCCTGCTGACGCCAGCAAGG TGGTGGCCAAGGGCCTGGGGCTGAGCAAGGCCTACGTAGGCCAGAAGAGCAGCTTCACAG TAGACTGCAGCAAAGC | SEQ ID NO: 2048 |
| FLNA | ADXCRPDRC.16964.C1_at | AAAAGTGACCGCCAATAACGACAAGAACCGCACCTTCTCCGTCTGGTACGTCCCCGAGTT GACGGGGACTCATAAGGTTACTGTGCTCTTTGCTGGCCAGCACATCGCCAAGAGCCCCTT CGAGGTGTACGTGGATAAGTCACAGGGTGACGCCAGCAAAAGTGACAGCCCAAGGTCCCG GCCTGGAGCCCAGTGGCAACATCGCCAACAAGACCACCTACTTTGAGATCTCCACGGCAG GAGCTGGCAC | SEQ ID NO: 2051 |
| SPTBN1 | ADXCRPDRC.1211.C4_at | CAGGGCTTGTAACCTTACCCGTCTGTAGAGAACTTCTGGGCGGAGGCATTGACACCTCTC ACCCGCTCTGCCTGGATGCCAATGTCTGCTTCAACCAGGGTGTGCTTCTGTAACAGGTCT TCCACACCAAGTAAGTGTTTGCCATAGTCTTGAGACAATACTAGCACCTTCATTTCATCC ATCCAGTCCATAATGTAGAGCATTTCCTGGAATATCTTCTGAAGCCCCAGGTTAATCTGA ACCGCTGGTTTCCGGGC | SEQ ID NO: 2052 |
| SPTBN1 | ADXCRPDRC.5087.C2_s_at | GAGAGGATCATTTACATCCGGGAGCAGTGGGCCAACCTAGAGCAGCTCTCGGCCATTCGG AAGAAGCGCCTGGAGGAGGCCTCCCTGCTGCACCAGTTCCAGGCAGATGCTGATGACATT GATGCCTGGATGCTGGACATCCTCAAGATTGTCTCCAGCAGCGACGTGGGCCACGATGAG TATTCCACACAGTCTCTGGTCAAGAAACACAAGGACGTGGCGGAAGAGATCGCCAATTAC AGGCCCACCCTTGACACGCTGCACGAACAAGCCAG | SEQ ID NO: 2055 |
| ATP2B4 | ADXCRPDRC.5728.C1_s_at | TGGAAGGAGATGAGCTCCCATAACTGAATTGGCCTTTGGTTCATGTTTTCTCCCCATATG TATATATGCCCATATGTGAATATGCCATATATATGTGCCCACAAATCTATCTACGTTGTTC TTTTCAAATTAGCACGCAGATAGGAATTTTGAGTTTCTTCTTCTTTTAGTAACTAGTATA ACAAGCACTGGTATTTT | SEQ ID NO: 2056 |
| LAMB1 | ADXCRPDRC.10237.C2_at | CTGTGGTGGTCTGGTTACTGTTGCACACAACGCCTGGCAGAAAGCCATGGACTTGGACCA AGATGTCCTGAGTGCCCTGGCTGAAGTGGAACAGCTCTCCAAGATGGTCTCTGAAGCAAA ACTGAGGGCAGATGAGGCAAAACAAAGTGCCTGAAAGACATTCTGTTGAAGACAAATGCT ACCAAAGAAAAAATGGACAAGAGCAATGAGGAGCTGAGAAATCTAATCAAGCAACATCAG AAACTTTTTTGACCCAGGATGTAGGAACTGGTCTCTGGCCCAGAGA | SEQ ID NO: 2057 |
| TGFBR2 | ADXCRPDRC.12527.C1_s_at | AGAGCTGCTGCCCATTGAGCTGGACACCCTGGTGGGGAAAGGTCGCTTTGCTGAGGTCTA TAAGGCCAAGCTGAAGCAGAACACTTCAGAGCAGTTTGAGACAGTGGCAGTCAAGATCTT TCCCTATGAGGAGTATGCCTCTTGGAAGACAGAGAAGGACATCTTCTCAGACATCAATCT GAAGCATGAGAACATACTCCAGTTCCTGACGGCTGAGGAG | SEQ ID NO: 2059 |
| PDLIM7 | ADXCRSS.Hs#S5951004_s_at | TGGCAGCACCTGCTTACTTACCACTCATGGTGCAAGATGACACTTCAGCCTCCGCCAAAA TGCTCACCTTCCAGCCAGCAGGAAGTCGGAAGGAGAAGAAAGGGGACAGAGCCCCATGGC GTCCATCCTTAGAGGATGCTGCCACCTGAACCTCTGCTTT | SEQ ID NO: 2060 |
| LPP | ADXCRSS.Hs#S1294625_at | TGAAGGTCTTCAGCAAAATTTGGACTGTAAACACAGCTTGGCATTATCAGCATTCTGTT AAGTTCAAAGAAGAGATAGTTACAACAAATACAGCTTGCTTTATTTCTGAAACAAACTG TGCACATATTTGTGGCCATACTACTAATTAACCTGTAGATTGTTCCTTTCATCTATTCAG CGTGTTTTTCTGCCCCCTGTTACAACAGTGTTGGGTTACTTTTCCCATATGGACTATATT TAAACAGTTCCCTTATAGGCATTAGAG | SEQ ID NO: 2063 |
| NT5E | ADXCRSS.Hs#S1299958_at | ATTGAACAGAGAATCTACCCCAAAGCTGTGAGCTTAATTACTCTCAAGCTCCGGGGTCAA AGAGATCTGGTGTCCATTCTTATCACGTCTCCCTTTTTGCGGGGATGGTGCCTGTTAATT TATTCAGCTTCTTCGACGCGGTTTCCCTTTCAATAAGATTGAGATAAAGCATTTTTCGAA AGATCTAGATTGAGATAAAGCATTCTTTGAAAGATCTAGCAGTAAA | SEQ ID NO: 2064 |
| CRIM1 | ADXCRSS.Hs#S1805720_s_at | GAAGATGTTTGTCTGAGCATCCCATGAGGTAAGCAGCCCCATGGAAGGACCAGCTGCATC CAGCAAAGGGCTCCAGGTCCCTGACGTAGTTGACGGTGATGGCAGAAGTAAATCTTTGTA TTCTTGCAGAGACTTTGTTTTTCTGTCATTCCACAGCAGCTCAGCATACTCTAATAAACG TCCTCCTCTTCCCCTTCGTAGCATTCTGGGACTAATCAGGGTTTCATCTGCTCACATATT GTAGCGATGGGTTC | SEQ ID NO: 2065 |
| CD44 | ADXCRSS.Hs#S1228681_at | TGCATTCCATTCCTTGTGTCTTAAAAGCAGACTGCAGTGTAGCTGAAGCAACCTTCTATT CATGCCAAAGTGCTTTATTCTGTGACTATACCTTGTATTGAGCTCTAAAACCTCAGAGAG CTTTAAACTGGTTTTGCCTTTATAGAAAGGTTAAGTCCATTTGTGCATTACAGCTTTTAT TCTGTGTGTGTGTGCATACTTAAATTAAAATGGAAATTTATTTGTTAGGTTAGTTTCTCC CAGAATTGCTCCTGGCAAAGAG | SEQ ID NO: 2068 |
| CD55 | ADXCRSS.Hs#S2874822_at | GTAAAAGGAGATAGGTCACATCATCTAAAGAATTAAAACAGACAATTTAATAACAGCAT TAAATTAATAGTTTTCTTATTAATGGGAAAAACGGACAGGCATTAGGGCAGCTTAGAAAT AACTCAAGTTTGTATAAAATTCCACAACTAGT | SEQ ID NO: 2073 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| CD55 | ADXCRSS.Hs#S2874822_x_at | TATTTTTCTACAAGACTGACTCATTTAGTGAGTTAAAGAATATTTACATGCTTTAACTTA TAATAGGCTTAAGTAATATTCTTAATTTAAGTAGAAAAATTGTAGAGGGTAAAAAGGAGA TAGGTCACATCATCTAAAGAATTAAAACAGACAATTTAATAACAGCATTAAATTAATAGT TTTCTTATTAATGGGAAAAACGGACAGGCATTAGGGCAGCTTAGAAATAACTCAAGTTTG TATAAATTCCACAACTAGTTTTCTGAACAGT | SEQ ID NO: 2074 |
| CD55 | ADXCRSS.Hs#S2948409_at | TTGGTGAATATCCTTGTACTGTATATTTTCATATTATTGGAGGTATATCTTCAGAGTTCA TTTCTAGATGTGAGACTGGTGGATCAAAGGGTAAATGCGTATGTGTGGGGTTTTTTTTAG ATATTGGAAAATTCCCCTATAAAATGGCCGTATCAGTTTGCATTCCCACCAATAATATAT AAAAACATCTGATTTTCCACAGCCACACCAATAGGAAGTCTGGTCACATGAAAACCACAT TCTCAACATAACTAGAAGACAAAGCACCTACTTCAAATTGCCTATAAG | SEQ ID NO: 2075 |
| RCN1 | ADXCRSS.Hs#S1371296_at | AGCTCCACAGCTGGCCTAGGTTTCACAAATTTCCCACTGAACTCCACTGAGGTACCCTAA ATGCTAGCCCAGAGCAAACTTCAGGCTGGGAACCCACTTTTGTCATCTCTAGACCAGATG GTCCCAAACCAGGACAGCATCCCAGTGGGGAACTTCAAAAACACCTCCAAGCTATCCCCA GTGTTTAAAAAAGTTTCACCCTTGTAGTCCATTTATCTGGGAGGAGGTCATACAGGCTAA CTCTAGATTTCTTTCTTTGTTTGGGCTGGAATTCTAACAGCTTC | SEQ ID NO: 2077 |
| LAMB1 | ADXCRSS.Hs#S1582622_at | CAGAAACCCTGGGAGCAGCATGGTGGAGTAGAAAAGTATGAGCTGGGCATTAGACGGGCT GGGCTTTGAGTTTTGGCTTTGTTGCTTGTGTACTTCAGTTAGGATTTCTTAGTTGCAAGC AGCCCAAAACAGCTCTGGCCAGCCTCACCATGCCTTGGCTATGATAAAAGCCATAAAGAG GAATGGCACCGCTCCTTGATGCTGTTGGCAGCAAGTACCTGGAATTATGCTCCCACCAA GACTGCATGCATGG | SEQ ID NO: 2078 |
| PHACTR2 | ADXCRSS.Hs#S1584468_s_at | AGAAGACCAGCGACAAATTTAGAGAAACCTCGGCAGTATTAGAAAGGAAGATATCCACAC GACAAAGTAGAGAGGAGCTGATAAGAAGGCGAGTGCTTAAGGAATTGCCTGATCAAGATG GAGATGTAACAGTTAACTTTGAAAATTCAAACGGGCACATGATACCCATCGGAGAGGAAT CTACCCGAGAGGAAAATGTAGTAAAGTCTGAAGAAGGTAATGGCTCTGTATCTGAAAAAA CACCCACCTCTGG | SEQ ID NO: 2079 |
| COL5A2 | ADXCRSS.Hs#S1048343_at | GAGGGCACACCTGAGAAGTCATTCCGCTACATGAACTCTGTTATTTTCCTTATCCCTTAT TTTTTCCTCCCCTTCACATCCAAATCTTTCAAGTCCGCCATCAAGTCTGATGTGCATCCT CTTTGAAACCTTTTTGAACATCATAGACATATTTTTTCTCTTTTTCTCTAAAAGGTAGCAC TTCCTCTTTCTTTAACACATTTAGCACACAATAAATCCTTTTATTTATTGCCCACTGTTT TCTAAATAACATTTATTGTAAATGTCATTGATTATTAGTTATATCATATGCTCCTTGA | SEQ ID NO: 2083 |
| SEPT7 | ADXCRSS.Hs#S1914581_at | GGGCCCAGAGTTTGCTCCCAGGGAATCTAATGAACCACCTGGAATCAAACATTTGGAGAG AAGGCCAGTCACTTTTATCGGAACGTCAGATGGTCATGGACCCTCAAGAATGATTGAAGA AATTTGTAAGCCCAGTTAAAACATCCACAGTCTTCTTTCCTCAGTGCAAAAGTTGCCCTT TTTGATATCTCATATTTAGAGTAAAAAAATTTCGTTAATAAGAGATCCTCT | SEQ ID NO: 2088 |
| ZDHHC7 | ADXCRSS.Hs#S1917518_at | TGTATTATATGATCTGAACCCTGGGGAACATCTATAAAGTGGGGACGTCCCAGAGACCTG CGGCCTTTTCCACCTGAGAAGGTGCCTCAGCCGATTCAAATAAGAGGATGTTCCTGTGTT CCCTTCCCAAGAGGATCTACCAGGAACTTCAGCGACAGCTGTTCCCAGGACACCCTTTAT TTTATGCTGGGAGGCATCGTCCTCCGTGGACCACTCATTTGGGGTTAGCTGCCTGTAGAA CCGATTCCTGGGACAAACCCGTTGTCACGTATCCACAGAATGG | SEQ ID NO: 2089 |
| FNDC3B | ADXCRSS.Hs#S1917639_at | ACGATCAACGGTGTGACTGTTGGGTGGTTGAATTGAAACTTAGGAGTGTATGATGTTCAT ATGTTCCCACTTGATCTTTCTCAGGAGTGTTTGTACATACAGCCTCCCTGTCTCCCCTTC CTCCATCCCTTCCCAGTCATTTCTAGTAACCACTGAACACTGTATGAGGTGGAAAGTCCA TCATGTAGTAGAGAAAAAGATTCAAGCATCTCACCTAAAGTTGTCTATGAAGTTTTCAAA AGCAAATATAATGATCTCCTTGTGCCAGTGGACTTCTTTGGTTTAT | SEQ ID NO: 2090 |
| ZCCHC14 | ADXCRSS.Hs#S1918747_at | AATCGGCTAGCAGGCTTTGTTTCTGCAGGCACCACAAACTCTATTCCAGGAGTCTTCTTG GGACACCCTATTATGAACAAGGCATCGCTGCTTCAGAGCCAGGGACCCCATCTCTTACTG TCGGCCATGCAACAAAAGATCAGACCAGAAAGGGCTCACCTGGATTGATCACAGAAGACA TTTAGGCTAAAAAGTTTCAGATTTACCTCCCACTGCAGCTATGACCAGACCCTCATCCCC TAGGCACCTGGTATCTGCCCAACTGAACTTCAC | SEQ ID NO: 2091 |
| PPP4R1 | ADXCRSS.Hs#S1919443_at | CCAGGATTCTTAAATGTTACCTTCTCTAACTAATATATATGGCTTGACTATCTAGACTTA TACTTAACAGGTATTTACATCTTTGAACACAGAACAGCTGATGGAGAAGAAGCATTATA AATAATATACATAAACTCAGTTGGTACAGATAATCCGTAATTGTTAATGTTGAACTTGTC TAAATGCTATATGTAATATCTTGCATCAGTAAGATAAAGTAATTATCCTTTCATATCGTT TTTTCCCACCAAATAAACAATAAAGGACCGAAATATCAAGGG | SEQ ID NO: 2094 |
| PPP4R1 | ADXCRSS.Hs#S1919443_x_at | GAAGTCCCAGGATTCTTAAATGTTACCTTCTCTAACTAATATATATGGCTTGACTATCTA GACTTATACTTAACAGGTATTTACATCTTTGAACACAGAACAGCTGATGGAGAAAGAAGC ATTATAAATAATATACATAAACTCAGTTGGTACAGATAATCCGTAATTGTTAATGTTGAA CTTGTCTAAATGCTATATGTAATATCTTGCATCAGTAAGATAAAGTAATTATCCTTTCAT ATCGTTTTTTCCCACCAAATA | SEQ ID NO: 2095 |
| COL4A2 | ADXCRSS.Hs#S2731998_at | TGAAATATACAAGTGAGTTCACCAAACTCATAAAAATGTCCTTAAAATGATAAAATGGAG AACTTGGGGGTCCCAACAAAGAGGAATTAAGGCCTGGATCATGATTACCTCTGTTTTCCA TGTGACTTTGAAAGCAGCAGGGCTGGAGCCAAGTTGGCCCTGCTCCCTCCTAGGGACAGC | SEQ ID NO: 2098 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
|  |  | AGGGTTGATGTCCACCTCCATTTCCATTTGCTTCTGTCCAGCCGGCAGGCTTGGCGGCCC CTCCTGGCTCTGGAGCTTTAATACTTTCTTATTCTATCCGATCAGCG |  |
| LPP | ADXCRSS.Hs#S1921588_at | GATTCAGTGGGCAACTGTGGCAATAGTTCTTGGCTAACCTGGTCACTATGGAAGTTCTTT CCGTGGAAAAGATTCTCCATCCTTCAATTTGAGATAAGATTTACTAATTGAGACCTCAT TTGTATCTGATTTTAATCTTTGCATCATTTTAGTTTTAATAAACTAACTTTCCAACTTAC CAGATTTTCGGGTTGACAAAGACCATTATTTAGAGAAACACAGGCAAAGGAAAGTCTAAA AGCTTTGGCTGGAATTTCAACTGCTTCTGGTCCAGAAT | SEQ ID NO: 2104 |
| CREB3L1 | ADXCRSS.Hs#S2306153_at | AAGCAACGTTGCACATCAGCTCCACTTGGACATCATGAGTATCACGCTGAGCATGAGCTT GCACCAGCCCTGACATTGTGGGACATGTGACTGCCAGGCGCTTGTGTCTCAGCTATGACA TCAGAAGCCCCTCTGCAGGGTCAGAACGACAGTTGACATCTGGGTAGCCAATTCCTGGGT GCTGCCTCATCTAGACACCACAGAGGCCCAGCTCCTTTACCAGCCTCGGCCTTGGCATAG ACATCA | SEQ ID NO: 2107 |
| LPP | ADXCRSS.Hs#S2732094_at | CAAAAATTCCTGCATATACCCACTCAGGAAATATTTTCCCAAATCTTCTCCATCTCAACT CTGTGAGGCATTGGAAGAGGTGCTTTTAGGCATAGACTGATGCACTCTATATATGATGTC TCGCCCTCCAGGGCAGCACACAGTTTAGTGAGGTAAATGTCTCATGAATATTCCACAAGA TCCACCTTGATAATGCTCTAACGTTACTCATAGAGGGCTGAATGTGGAAAGATGCTTTCG TCTGGTGGCAAA | SEQ ID NO: 2109 |
| FNDC3B | ADXCRSS.Hs#S1927775_at | AGGACTTTGGTAACAGAACATTCTGTCACCATTAACTTTTGCTTGACATTGGATTATTTC TAAATACAGTTTGGCTGTCTTCTGATCGGACATTTTCAGAGGAAATGAAGTTAGGTTAAA CAAATACTACGTGAAAGGCTACATTTGATTTTGACAGCCAAGAATGTTTCCTGGGTATGG AGTTTTATGAAGAATCTCCTATTTGCTCTGGTTAATTTGATATTGCATTGCCCATAGTTA CAGAGTACAGTCCCCATCTGTACATCACCTACCTATTTC | SEQ ID NO: 2110 |
| RYBP | ADXCRSS.Hs#S1924603_at | TCCATAGTATTTTAAGCTCCGTAAGGAACAGGGACCTGGTCTGTCTTTATACCACTGTAC ACCAAGAGCGCAAATGGCTGTGTGCTCAATAAAAACTTGTCAAATGACCACAACTACCCA GGTAATTTACTTTAAGGTCACCAAGTACACATAAGATCAAGTCACCACCAATAAATCAGT AAGTCCAATGAAACAGTAAACACAAAATAAATTATTACTCTGTTCCTGGGTAAAATGATC TTAAATTGTACCAGCTTTCAGCTTGGAAGGTTTGA | SEQ ID NO: 2113 |
| PLAUR | ADXCRSS.Hs#S1925412_at | ATGGATGAATGTGTGGACGAATAGATAGATGAAAGAATGGATGGATGGATAAATGGGTAG ATGAATGGAATGGGTGGATGGATAGGTAATTGTACTGATGGGAGAAGACTTGTCTTGCTC CCATCAGCCCCCTGAGTAGCTGGGGTTATAGGTGCACGCCACCACACCCAGCTAATTTTT GTAATTTTTTGTAGAGACAGGGTTTCACCATGGTGGCCAGGCTTGCTCTCATACTCCTGA CCTCAGTGGTCTCCTCCTCAC | SEQ ID NO: 2114 |
| PLAUR | ADXCRSS.Hs#S1925412_x_at | ATGGATGAATGTGTGGACGAATAGATAGATGAAAGAATGGATGGATGGATAAATGGGTAG ATGAATGGAATGGGTGGATGGATAGGTAATTGTACTGATGGGAGAAGACTTGTCTTGCTC CCATCAGCCCCCTGAGTAGCTGGGGTTATAGGTGCACGCCACCACACCCAGCTAATTTTT GTAATTTTTTGTAGAGACAGGGTTTCACCATGGTGGCCAGGCTTGCTCTCATACTCCTGA CCTCAGTGGTCTCCT | SEQ ID NO: 2115 |
| FLNB | ADXCRSS.Hs#S1926534_at | GTCAGGCTCACATCTGAAACATGTTTAAACAGCTAATGGAGCTGAGCAACTAAAAGCTAA ATGAGTTTCTATGCTGGGCTGCCTATGAGACAAGGTCACAATAGTTACCAAGTATAATAA CTATTATTAAGACCCTGGCAGTCCCAATAAAAGTAGGTCCTAAAAACTTTTAAGAGAC AGAAAGTGGCTGGAACACCTCCATGCCGTGGTTGACCAAACATATTTCTAGCACAAGGGA GACTGCAAACCACAATGAGACTCAATGAGACCTTCATTTAATGTGGGACACAG | SEQ ID NO: 2117 |
| LPP | ADXCRSS.Hs#S1908923_at | TGCCCTTTTTTGTGCCTGGGCTTCATCCTTGGAATGTTTTACCTCATGGGCCATGAGACG GCTGCCTGCTGAAACCCAAACTATAGATATCCCTGTTCCCATTTAGGGGAAAGAGCCTGG TTTGCTATATTCTCATAGGCTTGGCTGACTGTATATTTCTGAACCAGTCATTGAAGCCAA GAGAATGGGATTATGGTAATATGAACCACTATTCTCCTGAAACTGAATTTGGACATAGTC CCATCCAAACCTCATGGTACTTACACAGTGG | SEQ ID NO: 2119 |
| NR3C1 | ADXCRSS.Hs#S1907985_at | GGGACTAATGTAGCCTTGCTTCTGAGATGTGGCCCCTAGGTCTCTACTGAATGCCCGCA TATTTAATTAGATCTTTCTTTCCTCTATGGCCTCAAGGGATTTCACCCTAAGTATGCACA AATTTTTATTCAGCCGAAGACTGTACAGATTTCTGGAGGCCTTTCTTTGTGTACCTCCTT CGTTTCCAGTAGTCTGACCCATAAATTGTACAGATTTCTG | SEQ ID NO: 2121 |
| LAMB1 | ADXCRSS.Hs#S1908684_at | TCTTGGGAAGACTCATAGGCCTTTTCTAGTAGAATCTTACCTAGCATCAGCCCTCATAAA TTTGCTGATGTAATTTTAAGTTATACTTTCTAGCTGCTGGAACACGCATGAGCGAGTGTC TATCCTATTTCCTCAAAGTTGCTCAACTTGCTTAAGAAATACATAACTGCATATTGGACA TCAGAAGTGCTTGGTTCTAGCTGGGGAAAAGGATGGTTAATTCCCCCCTAAAGCATCAT TGTTTTGCAATCGAGTGAATCGGATGGATTCTCCTTCCCAG | SEQ ID NO: 2122 |
| LPP | ADXCRSS.Hs#S1910599_at | GAAGACAACAACAGGTAAACGAGAAAATCCTTGGAAAAGAACACCGTTAATTTACAATAG TATATGTCTCTCTCTGGCCAACGTACTTTGTTTCATGACACTACTGGCATCATCCATCCC AAATACTTTCGGTCGCTGTGTGTTTCAGACTCTGAAAAACCTTCAAATAACACAATAAAA CCTGCTCCTCTTTTCCTTTAATCTTACATAAAGGCAGTTCTCTTAAGTCTATAGTCAAAG C | SEQ ID NO: 2123 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FNDC3B | ADXCRSS.Hs#S1910605_at | TAAATGAAGACACCTAACGGTTTGAAACCTTCTGGCTCTGAGGAGAGGAAGAGGGTCCCC AGATACAGGTTTCAATTCCTTACCATTTAGTCTGGTTCCATTGATCAGGGGTTCAGTTTT CTCACCTTAAAATAAGAGGATTAGAACAGATAATTTCTAAAATTATTTTTACCACCCCTT TTCTCTTTTCTTTCTTTAATTCCTGTGGCGTTCTCTGCAGTTTATATGTCCCTAATTTTA TG | SEQ ID NO: 2124 |
| LDLR | ADXCRSS.Hs#S1911522_at | TTGGCAGAACTTTCTGGCTTTTCCCCCTTCATGTTACGTGGGTCATTGAGGCTTGGCTAG CAAGCGTCACTATGTGTTCAGCCTCACGGGGCGGGATCACAGGATCACGGGGATCACGA CCAGCGGGAATCACAGCGGCTTGCCAGTGTGTGTGCCAGGTGGCTAGCCCTCGGTAGGGA CAGCCTCCCTGACTGTGCGTGACAAACCCGAAGAGGTAGCACCATCCCCACTTTGTAATG CCTCCTGGTCAA | SEQ ID NO: 2125 |
| MAP7D1 | ADXCRSS.Hs#S1907164_at | GGCTTAATGTGATTTGCTCCATAACACTGTGCCAATGACATTTCATCAGGGTTGGCAAAA TTGTGAAGAAAATATTTGTATTCAGGGTCAATAGTGTGCCGGGTCACAAGAGGAGTTCCA AACTTCTTGTTTGCCTCTTGAGAAGTTTTTCTTGTTGAGCTGCTGGAGTAAACACTCATT ATTATTTTTATTAACTTCTACCTGTGTGGCTTAGTCCAGGAAGCTGCCCAAACACTATTG AGATGGAGTTGTTTTGCTTCTCTTCAAATGTTTATCTTTT | SEQ ID NO: 2126 |
| SPTBN1 | ADXCRSS.Hs#S1929015_at | AAGCCAAAGACGATGTAAGTTTCTAAATGTTATTTCTCTCCACTACTTAGGAGTTTGCAA GTGTTTGTGTGATGATGGGCTTTATTCAGAAAGTTCTTCATGTAAATGATGATCAGTGAT GGTTTCTATCACTGGGCTCCAGTCACCAGCACTAGAAGGTGTTTGGTTCTGTCTCTAGAA GGCAGTGAATATGATCTCACTGTCCCTTTGCCGTGGCAGGATCCCTTAAAGTCGATGGAA TCTTTGCCTGT | SEQ ID NO: 2127 |
| PPAP2B | ADXCRSS.Hs#S524340_at | TGACTGATAGCTGCCGCTTATGGTTACTTAGTAAAAACTCCTGTTGCTAAATGGCTCAAA TGGATGTCTGTGTGTTTATTTTGCCATCTAATACAAAGCATAAATTTTTCTTACTCCAGT AGCTCATCAAACCCTTGAATCTTTCATCATAAGCACATTGAGGCAGGAACTATGCCTGTG CCATCCTCACACCTTTGCAAGTGGCACTCAATAAATGTTTCTCAAGTATTGTTCAGACTC AGTGAGGGTCACATCCCCAGGAGGAA | SEQ ID NO: 2129 |
| LAMB1 | ADXCRSS.Hs#S2732721_at | TTTTTCCAGGGCTCTAATCACTACTCTGTTAAATTCCTCAAACTTGTAATGCCCCAAGGC TTGATTTTTTCCAGATAATGGCTCTATCGTTGCACATACCCTGATTCTGTCAGGATGTGT CATTGGCAAAAGTAGCTTTCTCTGCCAAAGCTTTCTGACCGTTGGCTCCATCTTAGCGTT GTTAGCAGGAAAGGCCTGCTACCCAGAGTCAGAGTCAATCAGAGAATAGTTCATGTGGTC CTTAGAACTTTACTCCT | SEQ ID NO: 2130 |
| FLNB | ADXCRSS.Hs#S2733261_at | GATGTCAAGACCACTACCTTTAGGCACAGAACATTCTACTAAGATTTCCATTTTTGTGTA AGGTTAATTTTAATCCCTAGGATTTCAAAATTCTCTCTTTCAGGATCCTGCTCACCCTAT CTTCACTATTGCATACCTGAAACTTCAAATCACCTCTCTATAAAAATTTAAGGGTGGA GACCACAGTCATTGCTTCAAAGGCATCAAAGTAGAACATATCTAGAAGCTAACTGCATTT CAACCAAAATATTGATGAAAATTTATTACAAACTAGTCTCTCTCCAGA | SEQ ID NO: 2131 |
| ARID5B | ADXCRSS.Hs#S4463141_at | CTGTGTTCAGCAGTGGGTTTACATGGGTGAACATGACAGCACCTGCTCTCAGGGAGCTCC CACCCCTATCCTCCATTGATGGAGAAAACAGATGAGACTCCAGACCAAGGAGGAGTTGGT GGCTCCCAAAGAAACAGTGGAGCCCAGGGGATGAATAATTAAAACGTAAAGCACATCCCA GAGCTCAGCACTTTGAAGGTGTTTATGTCCCAGCTCTGAAAAAGATGTTCTGTATTTCAT CTCTGAGTCTGAGATTCTAAAAGCTATGGTTGGTACA | SEQ ID NO: 2134 |
| ARID5B | ADXCRSS.Hs#S3010218_at | ATGACTTCAATGACGAATCCTACTGGCATAACATCTATGGTTTCACCAACTCTTAGCAGT GATCTTTGGTTCCAGATTCATGTGAAAAGCCAAGAACCGCTTTCCACAATTTGTCTTGTC ATGACTCTCCGGCTCCATATTTTAAGAAGCAGTCTACACTAGCCCTTGAATCTAGACTCT AATTTTTTAAGATACAAAGGAAATCATTAAGCCCCGGAATATTAGTAGAATATACGGCAA TATGGATCAAGTAATCCAAAGTATTAGCAATGGTGCAAGAGGCTGTCA | SEQ ID NO: 2138 |
| FNDC3B | ADXCRSS.Hs#S2978758_at | ATGTGAGAGTGCTTTGCAGTTGGAAAGTGCTGTAGGAACCCTGAATTCATCTGAAACTGT AGCTTAGTGTGTTTAAATGATGTCTGTTATTACTTTTTTGAATAGTCTGGAGTGCTTGTTAA AGAAAAAATTATTCTGTGATATTTGTTGAATGAAGCACAGTGAGGAAGACTTTACTCAGG GCCCTTGTAATAGCTATAGGGACCACTGCAATAGGGTCTTGCAGTGGGGGAGAGAGAATA GGCTCAATTCTGAATACATCATCATGGGCAAGTGGG | SEQ ID NO: 2142 |
| GALNT2 | ADXCRSS.Hs#S2734613_at | AATGTGGCATGGGTTCCAAAGCTCTGTGATTTTCCTATACTGAAAGATTTCTCCCAACCA TGGAGGAGCCTAACAATTCAGTCTTCAGGGTCTCTAACAGCACTGACACACTGGATGTTA ATTACATTGTGATTGGAGCTTCCTTCCCAGACACTCCAGTGTACTACTTTCCTCCTTTAC AGCCTCTCTTCTAACTGCCAATAAAAGAGTCCTCATGAGCTCAGCTCCAGCACAGATAAG ACTGACAGAAGGTTCCGAGGTTGGCATTTGCAAAATCGCATGAGCAT | SEQ ID NO: 2145 |
| PHACTR2 | ADXCRSS.Hs#S2978384_at | ATCTGGGAAGATTCTTAGAACCTATAATATTAAACATTTCTGTAGCAAACATGATTATTT GCTCTAAGTGGAATAAGTAAAGATTTTTAATAGCGTCACGTCACTTCAAGTTATGACACT AAATGCATTTTGGAGCGAAACTTACAAAAAACAATATTTTTAAAACTTTCTGGATTTTAG ACTTGTGAGTAAAGATTAGATTTTATATAAATCGCATTGTGAGTTAGGGAGTGCTTAATG GACTGGCCTTGGAAGCCAGTCAGTATTTATGGCAAGTCAGTGCGTAT | SEQ ID NO: 2146 |
| PTPRK | ADXCRSS.Hs#S2979568_at | TGCTGTGTTAGCAACTGACGTACAATAAAGTTGAATTCACCCGAATATCTAAGTCTTAAA AGATAAATGCAAGTAGCTGGTAGCTGATTTAGGCACCAGTAACAGAAGTGAACACCTAAA | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | AAGTAAATGCTATCACAGGTAGGAACATGTGAGTGACCCTGATTACTTGTCAGTAGGAAA AGATGTGGAGTGCAGGCATATTCTCTTTCTACTTTGGATCAGCAATCAGATTCACTCACA GATCATCGATTC | 2148 |
| KDELR3 | ADXCRSS.Hs#S3732256_at | GGCTTAACCAGCTAGACATTCCTCTAAATACATACGTAACAAAAATTGATGGCAGGAGAT TTTATTGGGATCACTGGATACCTACACTCAACAGGCAGAACTTGGCTAATTCCATTTATA CCACTACTGAGACAGTGAAGACAAATTAAGAATCAGAACAGGAAGCACATAGCATAGGGA TACCCGTGTCAGCGACATATTTAATATGCCCCTCAGCTTAAGACTCAATACTGAACAGAC CAAAAGGCCACCTCAATTGCCGCTCCCGCCACACTTGCTATTGAAACT | SEQ ID NO: 2149 |
| SLC20A1 | ADXCRSS.Hs#S2981378_at | ATGAGAATATCCAGCAAACCAGTCCTAAATGACTGATTACTGAAGATCAGATATAACTAA TGACTTCAGTAGTTGAGGTCAGTATTAATTCCAGCATTTTTAGCATAGACAGGAGAAAGG GAAGGAGATGATCATATTATCAGTGGATCCTGTGAAGACTAAAGAGGAAAGGTCTGTAGT GATTTAGAATCTGAGCAGGTCTCTTTGGTTGAAAAACTATCTAGGTTAACTCAGCGTACA CTAGCCTGCAGCCTTCTGA | SEQ ID NO: 2151 |
| OPTN | ADXCRSS.Hs#S2984022_at | AGAAGAGAGTAACCCGGTATAACTGGGACCAGCTTAAAGGAACTGCTTTCCATAACATTC TCCAACTAATTCTACACTAGTGAACAAGCACAGCTGGTCCTGGGTACCCCAGTGCCTAGC TCCTCCATGCTTCCTATGGAACGTGTGGAGACTCAGTGAGGCTCTGGAGAGGCCAGCTTA CAATGTACACACCCACGTTCTCCAAACAGTCACTGTGTAGCTTATAACACAACACAAAAA TTCTCGGAA | SEQ ID NO: 2153 |
| CAPN2 | ADXCRSS.Hs#S2984172_at | GAGCCACCACGGGTAGCAAAGTGAACTTCCCCCGAATCACGGTTAAGCCCCCTGGGCAC ATGGAGCTGTCATCTGCAGTTTTTCCCACCTCGGAGGCCTGACCCTGTGCTCTCCATAAT CAATGAGTAGATGTGGCCCTTTATGTTCCCTGAGGCTTCCCTGACTGCTCATTAAAAGGA TCTGCTCAGTCCTAGTGAATTGATTTACTTTGCCACAGTCCTTGAAGGATGCTACAGATC AAAAGGTGTCCAGGAAAGTGATCTTAAAGATGCTGACACTACTCCCAGTT | SEQ ID NO: 2154 |
| EGFR | ADXCRSS.Hs#S2984803_at | CGCATTGCGTGGGCACAGGAATCTCAATAGCTGGCCCCAGAGCAGAAGCAGAAGGTGT GAAGGCCTGGACTCTTCTGAGCTTGAGGTCAGGGGATCTACTTGCACATTAGAGTTATTT AAATGAGGAAAATGCATGCCCTTTTGAATCGATGTTGTCAAGCCTTTCTTTTCCTAGGA GAATCTTTCGATTCCCAGCATGGGGAAAGCATGTTTTCAGGTATTAAAATGAGTAAGGTT GTAACAGTTACCATGAATCCACATGTTGTGCCCCATTCTAAATCAAGTA | SEQ ID NO: 2155 |
| RBPMS | ADXCRSS.Hs#S2984882_at | ATCCTTTGATTGGATCTAGCCTCCAGCTCAATATACCTTCCTCAATTGGCCTACAAGAAG AAAAAGATCTGAAGCTCAGCATAATGCTGGCTTTAGCCAGAAGAATCCAGCCTTTAAGCC ATCTATATGTGTAGCCATGAAGGACCTTCTAATATGCCTTGTGAGCCCTTATGGGCCAC CTCACAGCCACAATTTATGCCCACGTGTCAGCCTCACAGACTCAGG | SEQ ID NO: 2156 |
| COL4A2 | ADXCRSS.Hs#S2984630_at | TTTTCTCTAAACGAAGGCTTTCTGCACAAAAGGTAAAAGAAATCCAACTGTTTGGCCCAT TTAAAATCAAGTCACTGAAGTTTCTCTGAGCTCAATCACACTCTTCATCTCTGAGGTTCA TCTCTGTTCTTACCACATGATAACGTGAAAAAATAGTTTCTTAAAGAGCTGGCCCCATCA TCTCCAGAAATGATGTTAGGGAAGGTCCGTGGAAGGCACAGGCCTGCAGTACTGAAGGCA GAGGCATAACTGCCAACCACAATG | SEQ ID NO: 2159 |
| LPP | ADXCRSS.Hs#S2984275_at | GTAGCAGAAGCAGGACTGGAACCCAGAACCCAAGTTGGACCACTAGACTGGTGCCTCTCC CTAAGCCCACTCTGCCTCTTCCATGTCTGTGAATGAGCTTACCACTCCTAGCTATGCAAA ACTGCATAGAACCATTTCAGCAAGAGGCTCAGGTAGCATTAAAGAAGTTCCCACCTCAAC GATGTCAATTTTTTGTTACTGTTGTCTTGAGGAAGCATGTTTGCTTTTAAACGCTCCCAA ATTAAAAGCCATTCTCAGCCTTCCTACAATTGTATG | SEQ ID NO: 2160 |
| EPHA2 | ADXCRSS.Hs#S3000558_at | TGAGCAGTGTTTCAGCGCCCAGAGAGACACTGTGGAGAAGGTCCACCAGGATGCCTACCT GCCTTACACAAGAGCCTAACTTTGGCACACCTGTGGCACACCTGTGGAGAGCTGTTCTGG CCCCGGTTGTCTGGCAGGCCTGGGCTACTCCGAGCAGGGTAACTGGGGCACAGAAGCTGC ACCTCCGGCTATACCCTGGTTTTTTCCAGTTCCTGATGCCCGCCCCTCAGGTGGCAGCATG AGGTGACTCAGGGACAGACGCACTTATCGTGACGCAAGTCCACCCTGTCGAGTG | SEQ ID NO: 2169 |
| FNDC3B | ADXCRSS.Hs#S3003052_at | TTTCTTCCTACTCCAGGGATCTCCTCCCTTCCCCAGGGTTGAAGCAATGCACACTGAAGT ATTAATAGTAGTGATCAGCACCTTCAAGACAGCAGGACCCTTCTGTTGCCTTCTGGCTGT GGTGTGATGTCCTAGGGCCTGTGGTGCATAAGCAGGTGGAATCTAAGCACTGACCCTGGT CATTCTACATATAAGAGGAAGAGGACTAGGAAAGCTCGACAAATGCTGTTCTCCTCTTCA TGGCAAAGCCTTGCTCTTTGGAATCCTTATCTGCATTTAAAA | SEQ ID NO: 2170 |
| MVP | ADXCRSS.Hs#S3017763_at | GTGAAATAAGCCACTGACCAGTAAACAACTGAGGCTTAAACCAGCATGCCAGCTCAGGTG GGGACCCCCAGCACTGGTTATATTCCCTAGATTCCTCACTGGATAGGAAAGTTGGGCCT CAGGCACTCTTCCCTCCTCTGCAGTCAAACAGTGCAGATGAAGAGCCAGGCTCTGTTCCC AGTGCTTTATGTGCTAACTTGGTTGATAATGTTATCCATTCTCATTTTGTAGATGAGGAA ACAGGCACAGGGTGGTCAAGGGACTTGTTCAAATCACTGATCCCATAAGGG | SEQ ID NO: 2174 |
| MALT1 | ADXCRSS.Hs#S3002450_at | GAATTGTGTTTGTTCATCCGTTAAATACTTACTAAGCTCCTGCTCTCTATGCCAGGAACA CACAATTAAATTAATGTTAGACCATCTCTGCCCTTACAGAACTCCTTAGCTTCTTGGAGG TAGTACCATATCAGTCAGGAGCAGAAATCCTAGCTGCTTTCTTCGTATATATCATAACA TTTAATTGTATTTTATATTATACTATTGGTTACAAATATTTTTTATATATCAGGATATAC TTCAGACAGCATT | SEQ ID NO: 2176 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|------|----------------|----------------|-----------|
| GALNT2 | ADXCRSS.Hs#S3741276_at | GGGAGCCAGACAGTAGACATGAAGTCAGTTATGTCGTGTGCAGAAAGGTGCTGTGTGCTG TGGAAAAAATAGAGCAGTGTATGGGGATTAGGGATGAGGGCGGAAGGATAGTTGCAGTAT TAAAGTGGTGATCACGTAGGCTCATGGGGAAGGCAGGATTGGAGCTGAGACTAAGAGGGA GCCATTGTGGTTCCCTCTGCTTCAGAGGTAGCCCCTGGTTTCATCTTCGTCCAGCCTCTT TTTCGGTGATCTCTCTACTC | SEQ ID NO: 2179 |
| AHNAK | ADXCRSS.Hs#S3016566_s_at | GGGTAGCATCACTGGCCCCAGTGTGGAAGTTCAGGCCCCTGACATTGATGTTCAGGGGCC TGGGAGCAAACTGAATGTGCCCAAGATGAAAGTCCCCAAGTTCTCTGTATCAGGTGCAAA GGGAGAGGGAAACTGCGATTGATGTGACACTGCCTACAGGTGAAGTGACTGTTCCTGGGGT CTCTGGGGATGTCAGCCTGCCTGAGATTGCTACTGGTGGGCTGGAAGGAAAGATGAAGGG TACTAAAGTGAAGACTCCTGAAATGATTATTCAGAAACCTAAAATCTCCATGGG | SEQ ID NO: 2180 |
| TGFBR2 | ADXCRSS.Hs#S3019327_at | ACCAGTTTGGAGGACTACGTGCACAGATGAAGCCAAACCTCTGGCCCATCATCTATTCCA CCCTTCACGTCCCTCATGCCCGGGTTCCACTGGAACCCAGCGGCCTCACACATCCTTTTG GCTTACAAATTTCCTAGCTGGTGACCATTCTCCACCACCTCCCCCCAAGTTTTACCATTC TCTATTGGTGCCCTACAACGGCTCCACCCTTGGAAATAAGGCCGGGTCTAAATGTTACTT TTTCTAGTGGGCCTTCCTGGATTATCCATCCCACGGTGATTCCTTT | SEQ ID NO: 2182 |
| TIMP1 | ADXCRSS.Hs#S2992355_at | GAGGGACAGGTGATCACACGGTATTGGACACAGGGAAAGGGAGCAGCCAGAATTTGTAAG GGAGCAGTCTCGGGCTTGGGGAAATAGCAAGAGAGATCAGGGACAGCCCTTAGGGTTGGG GAGCAGCCACAGGGACACAGAATAGCCAGAGGGAGCAAGAAACAAGCCCACGATTTAGGG AATGGCCCCGGGAAGGATCTCCCGTTGGAGGTCAGGGTCCAGGCACTCACTGTGCATTCC TCACAGCCAACAGTGTAGGTCTTGGTGAAGCCC | SEQ ID NO: 2183 |
| GALNT2 | ADXCRSS.Hs#S2992100_at | TTTGAGGCCCACCAGCTGATTCTGAGAACCTCCTGCACCACCATGGAAAAGGGATTCCCT AGCCTTCTACTAACCAAATACCCCAGAAGATACGATTTCAGCTAAAAAAGATAGTGGTTC CATTAACCTTAGGAGCCAGGAGGCGAGACCCTGATCCGGGGCGCTCTCTGCCACCTACCG CCAGAGCCAACCTCCCTGCCTCCCTCGGAACCCCCAACACCCCAGAACCTCATGACCCTT GCAGAGCCAGCCTGCTGCCTCCTTTGAAGAGAACCATAAGAGAAGCTTCAGG | SEQ ID NO: 2184 |
| TPM4 | ADXCRSS.Hs#S2991999_at | GTCGGAATGGAGTGCCACACGATGAACCACAAGAGGAAGAAAAAAACACGTGAGCAAACAA AGCACAGACTAGGAGAAAGCTGTGTTCCATGTGAACCAGATGAAGAAAACCAAAGATCTA TGGAGTTTGATCTCTAAGTGGTTTGAGGTTCTGCAGGGTGGATTAGCCACAATGAAGCTT CAAAACAGTGGTAACCAGAAGTGACAGAGCTTCCCCCCACTGGTCCCCACCCCTCAGTAA ATTTCGGGATATCCAATGACG | SEQ ID NO: 2186 |
| PPP4R1 | ADXCRSS.Hs#S624701_at | CAATGTGTTATGTTTTCAGATGACTTACGTATGTTTTTGTTCATCAGTATTTTAAAAAAT AATCACCTGTTTGTGAAAATAATGGTTTTGAAAACAGCATTATGATGAGAGGGAACTTCG TAATTTCATGAGAATGTAGATGGTGACTGTTTAAGTGGGAGCTCACATAGGCATTAACAT CACCCTCCTTTTGCACAGTCCTTTTAAGTCTCCTGTTAAACATCTTTTATTGTGTGTATT TAAAGGCACACAGATGCTTTTTCCTGTATTCATCTTACAAATTTACCTACATA | SEQ ID NO: 2188 |
| SYNJ2 | ADXCRSS.Hs#S756942_at | GGGCCATTCAATAGTGTATCTTATAAGATAAAAGGTGAGGTGTCAACATTTGGAATTATT TTATTCCTAAATAGCACATGAATTATTTTGTGACTACTTAAAGCAGATTAATAGAGTTGG TTTGCCGAGAGGCAGGGATGAGCTGTTCTTGGTCAATATCAACACTGAAGGCAGGGCAAT ATTTGTACCCCCTCCTGAAACCAAGTCCTTGAGCTCAAACATTCCAGCTTTTTGCTCATT ACTCATCATCCTAGAACTGGATTTGTAAGAATCATCTCTTTAAGAGTGT | SEQ ID NO: 2189 |
| PTPRK | ADXCRSS.Hs#S794492_at | GACCTTATTATTTCTCAGTTTACATACCAATACTCTCCTATACATACACAATATACTAAG AGGAATACTGTTGTCTTCGTACCCAAATTACACATAAACAGATAAAAACTGACTTTTGCC ATCCCTTTGCAAATGTTGTAGCAAATTCTAATGTTCTCAGGCCACGCTGGTTCATGATCC GAGAATCTGAGACAGTTATAGTCGAAATGTCATAGGAGGCAGGCGTGGTGGCTTGCCCTG TAATTCAGCACTTGGGAGGTCCCTTGGACGA | SEQ ID NO: 2190 |
| ARID5B | ADXCRSS.Hs#S797577_at | ACTAGATCTGTTTTTCCTGACCTGAACACCATACACCTGTTGAGTTCACTAAGTACTTTG GGGTTTCCAAATGATTGAGGAGGTGCTAATTAAAGAATCAACATTTAACGTTTTCAATG ATCCACCACCTATTTGATATTAACCACATCCTTCCACGGGATTGAGTTATAACTAATCCA GCCTTCAACTGGGGCAGTAAGAAGTGCTGAACCAGCAATACAAAAAGCTAGAGTTCTAAT CTTGGTTTGGTTGCTAACTTGCTAGGTGACCCTCAGTTTCTACC | SEQ ID NO: 2191 |
| FHL1 | ADXCRSS.Hs#S3747393_at | TGCAGCTCCCTTTGCCAAGGCATTTCCTATAGAATCCTGCCACCCAAAAGGTACCAAATA TGAGTTTCTATTAGCTTTCAACTTCTTTAAACATATGCTAATTTGTTCCTCTCCCCCGAA AAAGAGATTTGCACGGGTAAATAGATAGCAATTATTTCATTTGTGCAGGAAATACAAGAA TTGAGACTACTTTCTAAAACTATCCACAAACATGGTTATTGTGCTAGCAAACTTCCAGCG TAATTTAGAGAGAAAGAATGAGAGAAATAAATGAGCAGTTGCCTGGTACTCAC | SEQ ID NO: 2193 |
| WDR1 | ADXCRSS.Hs#S3747394_at | ACTTGGACCTGAGGATGGCCCCAAACTCCCTTGGCTCCTCTACAAAATCAGGGCACTTTT CAGGGAGGACAGCGTCCCACGATGGCCACTTATTTATGTGGTCTGTCCTTTGCAACAGTC TCCGCAACAGCCTTCCATTGAATTCTGTCTCATTGGACACCTTTCTGGGGACTGGGGACA GGGTAGGCCTGGGCCCGCAGGTTCTCAGCTTGCAGCTGACAGGGCACGGACAATGTGCCA GGCAGGAGCGGAGGCCCTTGCCAACTGATT | SEQ ID NO: 2194 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| PHACTR2 | ADXCRSS.Hs#S3747744_at | AGGGTAACCTCTCTCATGATTCATTACCTCCCACCGGCTCTCTCCCATGACATATGGGGATTATGGGAACTACAATTCAAGATAAGATTTGGATGGGAATACAGCCAAACCATATCAAAGAGTATATTATGATCCATGCTGATATGAAGGAAAATTATTCTGCCTTGGTATGAGATGGATTGTGAAAGAGAAGGACAAGATTTGCTGATTTATTCAAAACATATTTACTGCATGCTTACAATATACTGGCCCTCTTCTAATCAA | SEQ ID NO: 2195 |
| PHACTR2 | ADXCRSS.Hs#S3747744_x_at | AGGGTAACCTCTCTCATGATTCATTACCTCCCACCGGCTCTCTCCCATGACATATGGGGATTATGGGAACTACAATTCAAGATAAGATTTGGATGGGAATACAGCCAAACCATATCAAAGAGTATATTATGATCCATGCTGATATGAAGGAAAATTATTCTGCCTTGGTATGAGATGGATTGTGAAAGAGAAGGACAAGATTTGCTGATTTATTCAAAACATATTTACTGCATGCTTACAATATACTGGCCCTCTTCTAATCAA | SEQ ID NO: 2196 |
| LPP | ADXCRSS.Hs#S3748577_at | ATGGCAGTGAGCATTTATTCCGGGCTGAGTTTTACACTACCCATACTGTCTCTAACTCTCCCAACACTCCCACAAGGCAGGTGCTATTATCCCCATTTTACTTTTGAGAAAATTAAGGCCTAAAGAAGTGAGAAAGCTTGTCCAAACCGCTATAGCTCTTGGGCAAAGGCATTAGTGACCAATGTGTATTTGACTCCAAAGCCCAGGATGTTAGCCACAGTGCAGGGCTACTATCCTTTTATACAATCTGTCAGGCTTCTTCCATCCGTGGCATGTATTCATCTA | SEQ ID NO: 2197 |
| ZCCHC14 | ADXCRSS.Hs#S3747057_at | GGGTTTACTAGGCTACAATCTCTACTCCTGAACTGGAAAATGTTCACAATAAATAGGTCAGGAAAAAAAGGAATGATTTCACTGGTTAATGTGTACTCATAGGCACTGCCCACACAACGGTGTGTTTTCCACTTTCAGTACAGTCCCACCTTTCTTTTCCTCTGCTATTTTCTTCAGCCAGCCACAGGGTTAAGAGCATTAGCTCTGGCTTTGAATCCCAGCTGACCTCAGGAAAATTTCTTATCTGTGACTCAGTTCTCCCATCTGAGTGAGCTC | SEQ ID NO: 2198 |
| LAMB3 | ADXCRSS.Hs#S3745344_at | GTGAGTAATGCGGTGGCCCCAAGGTGGTGCTGAAATATCCTTCCTCAACAAAGAAGATAAGCAGCAAATGTTTTGAGGGTGGCCACAGGGGTCATTACTGGTGGGAATTCAGGAAAGTCAGCAAGGGGAGCTGGCGAGGGTGTTTCCGTCCCTTCTCAAGAGTCCGTGTGGCTGTGTGAACAGTGGGACATCAGGGATTTCTCCCCAGGCCTACTTTTCAGGATTCCCTCTACCTA | SEQ ID NO: 2202 |
| ACTN1 | ADXCRSS.Hs#S3748482_at | GGCACAGAGGAAACCCGCTGAGCCTGCTTCCTTAGTTCTGGCAGATGGGTCAGCCCCCACAGGACTCAGGATTCAATTTAGCCCGGGGTTCTGGCTCCATCTCCCACAGTGCCGGTGCCAGTGTGCTCCTAAGTACTGTTTGTGCAAACCTGGCTCTGACTGAGACAAGGAGCCTTAGGAGTAGTAGGGACAGGAGACACAGCAAACTAGGGCTCAGA | SEQ ID NO: 2203 |
| FNDC3B | ADXCRSS.Hs#S3748224_at | GATTGCCTAGGAGGACACTGTCCTCAGTCTTTGGGGCTAGAAGGTTGAAGAGAAGTAAACTTTGACTGAATTATCCTTCTCATAGAGTTTAACAGGCACAGTGGAAATTCCTAGGCCGATTTCACTCTCATATAACACTGTTGGCAGGAGAATGGGTAGCATGGGAGAGTATCAGCGATACCAGAATCTGACCAGAAGGACAATGTACAAGAAAGGTAGGGACTTTCTGAAGGCATTTTTGGTGGCCGTTGGTGGGGATTAGGTATACAGCACAGATTAGACTG | SEQ ID NO: 2204 |
| FLNB | ADXCRSS.Hs#S3748946_at | ATTCTTTGTCAGGAGAGTTTTGTGAATTTCTGTTTAGTGGCAAGTTGTAGAAACCACTTGAAACTGCTTAAAGGCAAAAGAGGGAGCCACTTGTCCCAGTAACTGAGACATCCCAGAGCCGACTGCCCCCAAGCATTACTTGGTCCCAAGTTTCAAACGGGTCTTCAGGGTTTGATCTCTCTCCTCATCTCCAGTCTGCTTCATTCATTTTGGCTCTATGTGGTGGCAGAAGGGCTTCTGGCATCTCTGGACCTTTATGCCTCCCAGGT | SEQ ID NO: 2205 |
| COL4A1 | ADXCRSS.Hs#S3748447_at | AAGGATTTAAACCAACCTGTGCAATGCGAGTGTGTTCAGATACCTGGAGCCAGCCTTTGGAACCTGCTGGATCAAAACCGAACGTGTGCTCTGTGGGCCCCTGAACACGAATCCTCTGTGGGGTTGATTGAGAAAGGATTCACAGGCTTCAAGTCCCAGCAAGATTTATTTGCTAGAATTCAAGCAAATCTTTACGAAAGGGAGTTCTCATGGATGAGGCCACTGTTGGGGGCTGGGCCAGGACTAGATGGAGCCATGGATTCCA | SEQ ID NO: 2206 |
| NT5E | ADXCRSS.Hs#S3735513_at | TTCCCTCTGGCAAGGAAAGACTCAGATAAAATTCCCCATGACTTCTAAAGGTGCTCCTGGGCATTACTTTTCATTGTTTTTCCTGGGGATGCTGTTTCCTCAGAATGTCGTTGTATTATAGTACATTCCTTAAGGGATATGGTTTTCATTTTCCTGAATGTTGCTCCTTTCTCTCATTTTACCAGCAACTTGTTACTCCCTTTCACTTTCAGACTCTTTTCTCTCTTTCCCTTCTCCTTCAGCAACTTCTCTCCCCATTGAAGTTAGAAGT | SEQ ID NO: 2207 |
| ZCCHC14 | ADXCRSS.Hs#S3734556_at | GCTTTAGCTGCCAAGTTTCTGTTACTTGTATTTTTAAAAACATGCTACTCCGATAGGTATTTTCTGTTACTTCTAAGTCACAGAATGACACTGATAAATCATACATCAAAATAGACTATTAAATCTTTAATGTTCAAATACAATTTTTCTAGAAAAGTAAAACGCAGAAGGCTGGAAGGTGTGACCGGCACTCCACTCTGGCCTTGCTCCTTAACTGCAAAGTCACACCTGCTGACTGGGCGCTTACCCTACCCCGACACCAGGAGGATGCCAGTCTACGCCTCGAAA | SEQ ID NO: 2208 |
| FTH1 | ADXCRSS.Hs#S3729871_at | TCCCTTTTCTGGATTCTCAAGCAGTTACTTTCACGGTCAGAACACGCAGCTATTATGATTGAAAACTTAAAAGGGCAACAATTTCAGTCTTGCTTCTAGGGCTAGACAGGAACTTGGCAACATCTGTGGCCTGTTCAGCAAAGGATGTTAATATTTAAGAATCTTGTCTTGGGCTGGGTGT | SEQ ID NO: 2211 |
| FTH1 | ADXCRSS.Hs#S3729871_s_at | TCAGATATTTCCCTTTATTCCAGATTTCCTGGACACTTTCACCCAATTATAAACACCCCACTTCAGCCCCAATCACGTGGGAGGAAGTGTAACTTCCCTTTTCTGGATTCTCAAGCAGTTACTTTCACGGTCAGAAC | SEQ ID NO: 2212 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FTH1 | ADXCRSS.Hs#S3729871_x_at | ATTTCCCTTTATTCCAGATTTCCTGGACACTTTCACCCAATTATAAACACCCCACTTCAGCCCCAATCACGTGGGAGGAAGTGTAACTTCCCTTTTCTGGATTCTCAAGCAGTTACTTTCACGGTCAGAACACGCAGCTATTATGATTGAAAACTTAAAAGGGCAACAATTTCAGTCTTGCTTCTAGGGCTAGACAGGAACTTGGCAAACATCTGTGGCCTGTTCAGCAAAGGATGTTAATATTTAAGAATCTTGTCTTGGGCTGGGTGT | SEQ ID NO: 2213 |
| COL4A2 | ADXCRSS.Hs#S3736483_at | CTTCCAGGCTGTTAGGAGTCTCACAGGCTCATCCGAAAACCAATTCATGCTCCTGAGCTTCATGGGTTCGCCTGCCAGTGGAGGCCTAGCCTCCATCTCGCTTAGGATGCCTGATGTGGGCTGATGGCAGAATCAGGGGAGCGACACCTGCTTCCCACACCACAGAGAAGCCTCTTCGGGCTGGGGTTGGCAGCAGGGACTAACGACAATGCCATAAACAGATAAACAGTGAATGCACCGAGTCACAGTTTTAACCCGCATTCT | SEQ ID NO: 2214 |
| PHACTR2 | ADXCRSS.Hs#S3740773_at | ACACACACAGATCCCAACAAGAATGGACACTGATGGGTGAGGACAGCTGCTCCCTGAGGAGATGGCCACTGGGCACTGTTGGCACATCATTCTGGGAAATTTCAGTTTAGAGCTTATTAGAAGAGACCCAGACACTAAAGGTCAAAGGCGGGACATGAGGAGCACAGGGAGGGGATGTCTATTGGCATTCAGAGATCTGTTATACTGTCAACTAAACCGCTCTCTGAATTTGAGCATTATGGTCATACAT | SEQ ID NO: 2215 |
| MVP | ADXCRSS.Hs#S4460147_at | TTCACTTTCCATAGTGGGAGTCTCGGGTTTGAAGTAAGGAGATTAAACAAACGGTCCCACCCTCAGTACCACTCATCGATCG | SEQ ID NO: 2218 |
| EGFR | ADXCRSS.Hs#S3896483_at | TCAAGGAAAACTCTACGTCCAAGTAAACTCAAGATATCAGGAAATAAGATTAAAAAGGAGTGTGGGGCTGCCACTGACATTTTAAAATCTCCTCTTTGTATTCTCTATTTTCAGAAAACAATTTCAACATCAAGCATGAAGTTTATGATGAATATAGGAAATAGAAAGGATGGTGAGGATTGAGGATTTGTCTGTGGGAAATTATTATTGTTCTGATATTTTAAAACAGAAGAGCCAAACCAAAACAACTGTTCTTTTGACTAAAAAGGTGATGAGAGATTTTTAGTGTCCCCA | SEQ ID NO: 2220 |
| CD44 | ADXCRSS.Hs#S3898008_at | GTGAAACCAAAAGAACGCAGGCAAGAAACAGAACAGGAGGGGGAGGGCGACTAAAACATACACTACCAGGGGAAGAAGAAAAAGTGGCCGCAGCCCCAGGAGGAAAATAAAGAAAAGGAACCCCACCACCTAGAAGACAGACATAATAAAAAAGAACACGCCGAGCATGCACGCGTCAAAAACAAAAGAAGAAGGAGAAAACAAGCACCGCACGAGGTGAAGTCATTTGTGAAGGAAACGCACAACACAATATGCGGGGAGGAAAAATAAGAGCGATACCACCCTCACG | SEQ ID NO: 2222 |
| COL5A2 | ADXCRSS.Hs#S821070_at | TCCTTTGGGTCCTGAAGAACCTACAGGACCCCGTTCTCCTTGAGCACCTTTGGGCCAGGTAAACCATCAGAGCCTGGAAAACCACGATTGGCAAGAGCACCCTTTCTTCCAATGGCCCTGGAAGAACAACTGTTCCTGAGGTCACTCTGGGAACCCTTTTGCCTTCTTTAGCGGGTGGGCCTATCGGACCTGGATACATGTGGCCTGGTTC | SEQ ID NO: 2223 |
| NR3C1 | ADXCRSS.Hs#S821188_at | AATGAGCAAGCGTAGTTCACTAAATATAAAGGAGTTTGTTAAAACCAGACAGTAATAGCTATAAAAGGCACAACTTCCCTTTTCTGATATACACTTGTAAACTTTTTTTCAGGTTTCCATGCATAAATCAAAAATGCTATCCTAACTATACAGGGGGGGGATACACCAACAGAAAGTCTAGAAAATTTCATCCAGCCAACTGTGTAAAAAAGTATGAAGAGAAAGTTCCTCACACAGACTTTGGGCACTGGTGGTTTAGGTGGCATCCATCTTTGACTGT | SEQ ID NO: 2224 |
| TGFBR2 | ADXCRSS.Hs#S849165_at | GGGCATTTCTTAATTGCTCCTCAGTTCTAAGTGTCCCTCAGAATGCCTCAGATATTTGCTTTGACTCAGCAGAAGAAGGGAAGATCGTGGCCAGAGATAGCCTGAACCCTGCGAGAGGAGGTTAGAAAGCAGAAAGCCCTCTGCCAGCCAGGTGGGTACCAATGGTCGTTCCTAGGATGAGACCTCATGTAACAGAGCCCAGGCAGTCCTGGGGAACTGGACATAGCTGGTGATTGGCAACAAGTTGATGGCCTGAGACCTTTGACACT | SEQ ID NO: 2225 |
| CAPN2 | ADXCRIH.1382.C1_at | GTATCTGGACCTCAAAATTATGGGAACATTTACTTAAACGGATGATCATAGCTGAAAATAATGATACTGTCAATTTGAGATAGCAGACGTTTCACACATCAAGTAAAAGATTTGCATATCATTATACTAAATGCAAATGAGTCGCTTAACCCTTGACCAGGTCAAAGAAAAGCTTT | SEQ ID NO: 2233 |
| CAPN2 | ADXCRIH.1382.C2_s_at | TGGCTCTGTTTCTCAGTACTTTGAAGTTATAACTAATCTGCCTGAAGACTTCTCATGATGGAAAATCAGCCAAGGACTAAGCTTCCATAGAAATACACTTTGT | SEQ ID NO: 2234 |
| CD44 | ADXCRIH.1441.C1_at | CATCAAGAACAGACAAGGGTGTGTAGCGGTTTACAAATACAGCCATAAAAAGTCAAACAGGATCTACATGGCATCATCATTCCCCTTGGCCAATCCT | SEQ ID NO: 2235 |
| CD44 | ADXCRIH.1441.C1_s_at | AATCGGACACCCTGACTGATGAATAAATGCCACAAAGGACTTGCCAAGTGGGAGAAAATATGAGGTTAGAGGATAAAGCCAGTACTCTCTTGTTTGGTCATAAACTTGCCTATCTGGTGATAAGATTCCAATGATGGGAATCCCTTTAACCTTTTGAGGGACTCCCCAGGCACTTAACTCATCCTAAATAGCAACTGCATCAAGAACAGACAAGGGTGTGTAGCGGTTTACAAATACAGCCATAAAAAGTCAAACAGGATCTACATGGCATCA | SEQ ID NO: 2236 |
| CD44 | ADXCRIH.1441.C2_s_at | ATGGTCCATTCACCTTTATGTTATAGATATGTCTTTGTGTAAATCATTTGTTTTGAGTTTTCAAAGAATAGCCCATTGTTCATTCTTGTGCTGTACAATGACCACTGTTATTGTTACTTTGACTTTTCAGAGCACACCCTTCCTCTGGTTTTTGTATATTTATTGATGGATCAATAATAATGAGGAAAGCATGATATGTATATTGCTGAGTTGAAA | SEQ ID NO: 2237 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| IL8 | ADXCRIH.1699.C2_at | TAAGAGCTCCACAAGTCTGCTTGTACGTAGTTATGTAGATTTACCTGAATATTTATCAAT TCATTTGTTTTCCATTCTTTCTCATGTTATGTCTCAGGCCTTTTATACCAGTTTCTTTCT GCCACAAAGACATCCTTAGAATTTAGTTTAGTGATGGTCTGGTGAAGACAAATTTTCTCA TTGGTTGTCCAAAGGAAGATTAATTCCAAGTTTGTTCTTGAGAGGTATTTTTGCTGGCAT ATGTTCAATTTGTCATAATATTTGTCAATTGTAAACTGTTGTGCAC | SEQ ID NO: 2238 |
| CD63 | ADXCRIH.1914.C1_s_at | TAATGTTACTGTGGGCTGTGGGATTAATTTCAACGAGAAGGCGATCCATAAGGAGGGCTG TGTGGAGAAGATTGGGGCTGGCTGAGGAAAAATGTGCTGGTGGTAGCTGCAGCAGCCCT TGGAATTGCTTTTGTCGAGGTTTTGGGAATTGTCTTTGCCTGCTGCCTCGTGAAGAGTAT CAGAAGTGGCTACGAGGTGATGTAGGGGTCTGGTCTCCTCAGCCTCCTCATCTGGGGGAG TGGAATAGTATCCTCCAGGTTTTTC | SEQ ID NO: 2239 |
| FHL2 | ADXCRIH.1926.C1_at | TTGTGATAGTTCAGTCCCAGGGAAAGAGAAAACTCGCCCTAGGCCCTAGGTGGGAAGATG GTTTGAAATTTTTGTAATCGAGTAAGGCACACCCAAATGTAAAAATCCTTTTGAATGATG CCTTTATAAATCTTTCTCTCACTGTCTATTTAAGTGCAATTAACATATGTCACGAACTTG AAAGTTTTCTAAACTCAATAAGGTAATGACCAGTTGTTATTTACAGCTCTGTAACCTCCC GTTGCGTCAAGTCTAAACCAAGATTATGTGAC | SEQ ID NO: 2240 |
| FHL2 | ADXCRIH.1926.C1_s_at | CGCCCTAGGCCCTAGGTGGGAAGATGGTTTGAAATTTTTGTAATCGAGTAAGGCACACCC AAATGTAAAAATCCTTTTGAATGATGCCTTTATAAATCTTTCTCTCACTGTCTATTTAAG TGCAATTAACATATGTCACGAACTTGAAAGTTTTCTAAACTCAATAAGGTAATGACCAGT TGTTATTTACAGCTCTGTAACCTCCCGTTGCGTCAAGTCTAAACCAAGATTATGTGACTT GCAATAAAGTTATTCAGA | SEQ ID NO: 2241 |
| FHL2 | ADXCRIH.1926.C2_at | CGCTTCACAGCTCGCGATGACTTTGCCTACTGCCTGAACTGCTTCTGTGACTTGTATGCC AAGAAGTGTGCTGGGTGCACCAACCCCATCAGCGGACTTGGTGGCACAAAATACATCTCC TTTGAGGAACGGCAGTGGGCATAACGACTGCTTTAACTGTAAGAAGTGCTCCCTCTCACT GGTGGGGCGTGGCTTCCTCACAGAGAGGGACGACATCCTTGTGCCCCGACTGTGGGAAAG ACATCTGAATCAACACAGAGAAGTTGCTGCTTGTGATCTCCCACACGAATTTTTATGTT | SEQ ID NO: 2242 |
| FHL2 | ADXCRIH.1926.C2_s_at | TCAGCGGACTTGGTGGCACAAAATACATCTCCTTTGAGGAACGGCAGTGGGCATAACGAC TGCTTTAACTGTAAGAAGTGCTCCCTCTCACTGGTGGGGCGTGGCTTCCTCACAGAGAGG GACGACATCCTTGTGCCCCGACTGTGGGAAAGACATCTGAA | SEQ ID NO: 2243 |
| MYL9 | ADXCRIH.2136.C2_at | TAGTCGTCTTTATCCTTGGCGCCATGTTTGAGGATGCGGGTGAACTCCACGTATTTGAAG TTGCCTTTCTTATCATGGGTGCCTCCCGGTACATCTCGTCCACTTCCTCATCTGTGAAGC GGTCACCCATGGTGGTGAGCAGCTCCCGGAGGTGGTCCTCATGGGATGAAACCTGAGGCT TCCTCGTCGAAGCAGGCAAGGGCGTTGCGAATCACATCCTCGGGGGTGCGTGCCGTTCA GCTTCTTCC | SEQ ID NO: 2251 |
| ACTN4 | ADXCRIH.2359.C1_s_at | TTGGGGAGACTTGGGGCCAGCGCTTCTGGTCTGGTAAATATGTATGATGTGTTGTGCTTT TTTAACCAAGGAGGGGCCAGTGGATTCCCACAGCACAACCGGTCCCTTCCATGCCCTGGG ATGCCTCACCACACCCAGGTCTCTTCCTTTGCTCTGAGGTCTCTTCAAGGCCTCCCCAAT CCAGGCCAAAGCCCCATGTGCCTTGTCCA | SEQ ID NO: 2256 |
| ACTN4 | ADXCRIH.2359.C2_at | TCAGAGCAAAGGAAGAGACCTGGGTGTGGTGAGGCATCCCAGGGCATGGAAGGGACCGGT TGTGCTGTGGGAATCCACTGGCCCCTCCTTGGTTAAAAAGCACAACACATCATACATAT TTACCAGACCCGAAGCGCTGGCCCCAAGTC | SEQ ID NO: 2257 |
| ACTN4 | ADXCRIH.2359.C2_x_at | AGGCCTTGAAGGGACCTCAGAGCAAAGGAAGAGACCTGGGTGTGGTGAGGCATCCCAGGG CATGGAAGGGACCGGTTGTGCTGTGGGAATCCACTGGCCCCTCCTTGGTTAAAAAGCAC AACACATCATACATATTTACCAGACCCGAAGCGCTGG | SEQ ID NO: 2258 |
| ID1 | ADXCRIH.2765.C1_at | GCACTGGCGAGGAGAGGGCGCTCCTCTCTGCACACCTACTAGTCACCAGAGACTTTAGGG GGTGGGATTCCACTCTTGTGTTTCTATTTTTTGAAAAACAGACATTTTAAAAAATGGTCA CGTTTGGTGCTTCTCAGATTTCTGAGGAAATTGCTTTGTATTGTATATTACATGATCACC GACTGAAAATATTGTTTT | SEQ ID NO: 2261 |
| RBPMS | ADXCRPD.1301.C1_at | TGAGGCAAAGCCCAACACACCTGTCTTTTGTCCACTTCTCCAGCAAATTAGATTTGTCTC TGGGAATGTGTTTGTAACATACCAACCTACTGCAGACCAGCAGAGGGAGCTCCCATGTTG AATTTGTTTGTTAGCTATTTTCCCCCCTTTCACAAAAACTATTTCTTGACGACCTTTGAG AGATTTCAATAA | SEQ ID NO: 2269 |
| RBPMS | ADXCRPD.1301.C2_at | AGGCTACTTCTCAGGGCTGGAAGTCCCGTCAGTTCTGCTGAATACTATGTCCCAGGTGTG TGATGGCGGCTGCAATCTGTCTTGTGGGTATTAATGCAATCTTCAGTGGTGGCTACTGTT CTCTAGCTTGTTCTACAAAACT | SEQ ID NO: 2270 |
| NPC2 | ADXCRPD.1525.C1_at | AAAAATTCTTGTCCCCGCCGCTATGTGGAACACCCACTCCCCACAACACCTAGTGTACTG CTCAACAAACACTTGATTTTCGCCCATGCGGGCAACTCTTANNNNNNNNNNNNNNNNNNN NNNGGCGAGATAAATATACTTTCCCGCCGCGGGAGGAAAAACACGCGCCGGNGAAAAAA TTAATTTCTTTAATTATTCGCCACCCCATTTATAACACACAAGAGCGGGGGGGACCACAC CCCCCCGCCGGGTGTTGTGGGCGCACACAAAAGAATATATT | SEQ ID NO: 2271 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| LMNA | ADXCRAD_CD620845_s_at | CACGCCTACCGCAAGCTCTTGGAGGGCGAGGAGGAGAGGCTACGCCTGTCCCCCAGCCCT ACCTCGCAGCGCAGCCGTGGCCGTGCTTCCTCTCACTCATCCCAGACACAGGGTGGGGGG CAGCGTCACCAAAAAGCGCAAACTGGAGTCCACTGAGAGCCGCAGCAGCTTCTCACAGCA CGCACGCACTAGCGGGCGCGT | SEQ ID NO: 2272 |
| ZCCHC14 | ADXCRPD.3467.C1_s_at | CCTTCACAGCTTCTATTGGACATATTTTCTTTTTAGGAATGAAGGAAAATTCTCCCATTT TTGAGCCATTCTTTTGTCAATTCTACAAAATTGCATGTAACTTTATAAATATTTTTAAAA GATATAGTTTTGTAAATATTTAATATTCCGCTAATTTGATTTTGAATTGTAAATGTCAAG TATTCTGTTTTTGGGGTTTTTATGTTTTATTATACTTTGTTAAAAAGGACAAATTGTACA TTTTTAGAATG | SEQ ID NO: 2278 |
| SPTBN1 | ADXCRPD.5087.C1_at | GGTTTCCATCCACGATGTCATGGGACCCCATGTTCTCAAGATGGACTCTCTGCTCCTTCA GGAACTGAAGGGCCTTGTCCACATTCTCTAAGCAGTGGATGCGCATTCGTCCCTTGGTGG GTTTAGGCAGCCTCTCTCCAGAGAGGACCTCCAGCAGCTTGATGAGCATCCGTCCATCTC GAAGGTCAGTGTACAGGTCTGTGATCCGGCAGGACACACGGGCAAGGTGGGAATTGACCC ACTTGGTGAAGGTCTTCTTCTGCACGGC | SEQ ID NO: 2283 |
| ATP2B4 | ADXCRPD.5728.C2_at | ATGGGAGCTCATCTCCTTCCATCTCTCCTAATCAAGAGCAAAGGGAACAGCAGGCCTAAC AGCAGGGTTGGGAAGGCAAA | SEQ ID NO: 2284 |
| ATP2B4 | ADXCRPD.5728.C2_x_at | CAATAGTCAATCTTTGGTTTTTCTTTTTGGTACAAAAATACCAGTGCTTGTTATACTAGT TACTAAAAGAAGAAGAAACTCAAAATTCCTATCTGCGTGCTAATTTGAAAAGAACAACGT AGATAGATTTGTTGGCACATATATATGGCATATTCACATATGGCATATATACATATGGGG AGAAAACATGAACCAAAGGCCAATTCAGTTATGGGAGCTCATCTCCTTCCATCTCTCCTA ATCAAGAGCAAAGGGAACAGCAGGCCTAACAGCAGGGTTGGGAAGGCAAA | SEQ ID NO: 2285 |
| MAPK1 | ADXCRPD.6501.C1_s_at | CTTTATTCACAACTTAGGTCTCAAATATTCTGTCAAACCCTAACAAAGAAGCCCCGACA TCTCAGGTTGGATTCCCTGGTTCTCTCTAAAGAGGGCCTGCCCTTGTGCCCCAGAGGTGC TGCTGGGCACAGCCAAGAGTTGGGAAGGGCCGCCCCACAGTACGCAGTCCTCACCACCCA GCCCAGGGTGCTCACACTCACCACTCCTGTGGCTGAGGAAGGATAGCTGGCTCATCCTCG GAAAACAGACCCACATCTCTATTCTTGCCCTGAAATACG | SEQ ID NO: 2286 |
| TMBIM1 | ADXCRPD.6583.C1_at | CCTCGCCTAATTTTCACCACAAAGATTTTCTTCCACCCCGTTCTCCTCTTCCTGTCGG TTTTACGGCCTCTCACGCGTGGCCATGCCGCTCACTATCACGGACACCCATAAGCCCCT CACATATATTCTTCCCCCAAAACACTCACTGAGAGTTTTGTTCCCCCCTATATCAGACC CCCATATATCGCGGTTCTGCCGCCGCCTTTATTGCACGCTGG | SEQ ID NO: 2287 |
| ZYX | ADXCRPD.7105.C1_s_at | TGACCCAGGACCCAACATGGTCTAGGGATGCAGGATCCCCGCCCTGGGGTCTGGTCCTCG CCCTCCTGCAGGGATTGCCCACCGTCTTCCAGACACCCCACCTGAGGGGGGCACCAGGT TTAGTGCTGCTGCTTTCACTGCTGCACCCGCGCCCTCGGCCGGCCCCCCGAGCAGCCTTT GTACTCTGCTTGCGGAGGGCTGGG | SEQ ID NO: 2288 |
| COL6A2 | ADXCRPD.9074.C1_at | ACAGCGCCCGCAAGTTGAGGTCATCGTCCCGAGGGTCGTGGCGCCCGTCCGTGATGACTA CCGCAAACACACGTGTCTTCTGGCGCCGGCTCTCCTTGATGAGGCGGTCGTAGGCAAACT TGAGGGCTGAGGGTGTCCAGGTGCCACCTGCAATCCACTCGAGGTTCTCGACAGCCTCCA TTGAAGCTCGACAGGGAGTCGATATGTTCGTCGTCCAGCTGGATGCACTCAAAGGTGCCC TCGTGCTGTACT | SEQ ID NO: 2292 |
| LAMB1 | ADXCRPD.10237.C1_at | GAGAATCCAGTTCTTTGGCTGTGCTGTTGCTTTGGGAAGTTGTGTCAGATAATTTCACTT CTACTTGAGCCATCATTTCTGTAACATCTTTAATCAGTTTCTCTGCTTCCTCAAAGAGAT TCCCTATGTTTTTCAGTGGCTCTGCTGCGGGGCTCTGCGCCAGGATGTCTTTTATCTCGC TGACTTTCCTCTCCACCGAGTCCACAGTCTCACGGTAAGGCCCGATCACACCACTGATCT TCAGGCCTTGCTTTCTCCAGGAATCTGTGTGTCCTGTTGGCAGCA | SEQ ID NO: 2296 |
| ZDHHC7 | ADXCRPD.11267.C1_at | GCCAGTGTTGTTAGGCAGTGTAACATTTACCGGCTGTGTACAGCAAACAAGCTATTTTT TAGAAACCGACGTTTCAGGGAAGAGGGGAGAGAGCCGCGGGGTCCTGCCCGTGGTTACTA TGAATGTATTGCTGTTGGAGGACATCTCGATCCAAAGAACAGCCGTTCCTGTGCGGCCCT TCGTTGCCCTAAAGCTTTCATTTTTTAAAGAAATAAAGAGTGCTTGAGGGCCTTGGAACT | SEQ ID NO: 2299 |
| ZDHHC7 | ADXCRPD.11267.C2_at | TGGGCTGGCGCCTAGTAGGATTCTTGCTCTGAGCCAATACATTACTGCCACTCGGGGTTA TTCACGGACCACGTTATAACCACACTTCCTCTTAGTCCGCACGAATGCCAGTGATTTTTC ACCTCCGCATAACTGTAATCCTGTTGATCTTCCTGTGCCTTGAGGGTCTTCTGTTTTTCA CTTTCACTGCAGTTATGTTTGGCACCCAAATCCACTCCATATGCAACGACGAGACGGTAA GCTTTGTTCTCGGCTGTGTGGACTTCA | SEQ ID NO: 2300 |
| ZDHHC7 | ADXCRPD.11267.C3_x_at | GGGAACCGAGTCTGTGCAAAGCCTCCTGCTTGTGAGTGTGGGGTAGGCACATGGGGGAGG GTCAGCCTGGCTGGGAGTCCTCAGCAGTTTGCTCCTCTTTGCTGACAAGCGCACTTGCCC CTTCCTCCTCTGCGCTCAGACTCTACAGCTACTCAGCAGTCCAGCTTCCGCTCCCACCCC GCTCCTGCTCCTGCGGAAAAGGCCCCAGAAGCCTGGAGAGCTGGAGGCGGCTCCAGGAAGTC AGGGTAGAAGGTGTGTGCAGGGCGTGCTCCTGCCTGGTGACAGAAGTC | SEQ ID NO: 2301 |
| TGFBR2 | ADXCRPD.12527.C2_at | TGGCAGGAGCCTGATGCCGGTCAACTTGAAATATGACTAGCAACAAGTCAGGATTGCTGG TGTTATATTCTCTAAAGCCTGGGGTCTTCATCACATGAGCAGATTCCCAGCCAGTGTTTT | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | GACAAGTGCTCCTTTGCAATCGATTGTTTGAACCTATATGTCTGATTTTACATCTACCTT CTGAGAA | 2306 |
| JAK1 | ADXCRAD_CN418378_at | TCCACAGATTATCAAGTCCTTCTCCTGCAACAAATGCCCAAGTCATTTTTTAAAAATTTC TAATGAAAGAAGTTTGTGTTCTG | SEQ ID NO: 2311 |
| JAK1 | ADXCRAD_AL555086_s_at | ACAACAAGACCATTTGTGACAGCAGCGTGTCCACGCATGACCTGAAGGTGAAATACTTGG CTACCTTGGAAACTTTGACAAAACATTACGGTGCTGAAATATTTGAGACTTCCATGTTAC TGATTTCATCAGAAAATGAGATGAATTGGTTTCATTCGAATGACGGTGGAAACGTTCTCT ACTACGAATGATGGTGACTGGGAATCTTGGAATCCAGTGGAGGCATAAACCAAATGTTGT T | SEQ ID NO: 2312 |
| NT5E | ADXCRAD_BX404438_s_at | TTGTGGGAATCGTTGGATACACTTCCAAAGAAACCCCTTTTCTCTCAAATCCAGGGACAA ATTTAKTGTTTGAAGATGAAATCACTGCATTACAACCTGAAGTAGATAAGTTAAAAACTC TAAATGTGAACAAAATTATTGCACTGGGACATTCGGGTTTTGAAATGGATAAACTCATCG CTCAGAAAGTGAGGGGTGTGGACGTCGTGGTGGGAGGACACTCCAACACATTTCTTT | SEQ ID NO: 2316 |
| ULK2 | ADXCRAD_BP319713_at | GAGCTTTTCCATTTGGTGCTCCAATGTCTCCTGCTGGACCCATCTGCCTAGTGGAAGGCA GCAAAATTTCAAGAAACAGGTGAGGTTGAGCAGCTTGGTGCAACCCCATGGG | SEQ ID NO: 2317 |
| ULK2 | ADXCRAD_BP319713_x_at | AGAGAAGACTGTCGGCGCTCTGCCATAGCACCGCAACCGTGTGAGCAGCAGGCTCATCCC GTGGACCGGTGGTGGGAACGTGAGGAAGAGGGGAAGGAAGGAAGAGCTTTTCCATTTGGT GCTCCAATGTCTCCTGCTGGACCCATCTGCCTAGTGGAAGGCAGCAAAATTTCAAGAAAC AGGTGAGGTTGAGCAGCTTGGTGCAACCCCATGGGGCCCTGGAGTTGGAGCTCAACAGCA ATGGATTTCAGA | SEQ ID NO: 2318 |
| RBPMS | ADXCRAD_CD172092_at | AGCTTTCCAGAAAACCTCCTTCTGACTTAAAACTCTTTTAGGTTGGACAGAAATTCCTGT CCTTGATAAAGAACCACCTAGAAGCAGCCCCCAGCGAGGGGTTCTTGAAAAGTCA | SEQ ID NO: 2325 |
| RBPMS | ADXCRAD_CD172092_x_at | AGGTTTCATTTGTCTTTCTGCATGTGTAATTCAGCCTTTAAATTTTAAATTTTTAAAAAT TATTANGCTGGACAGGCAGAGTTTTCGTTTGCCTGTTTTGCTCANTGTTTGTTTACAAGG CTGGGTGAAATAAACAGCTTTCCAGAAAACCTCCTTCTGACTTAAAACTCTTTTAGGTTG GACAGAAATTCCTGTCCTTGATAAAGAACCACCTAGAAGCAGCCCC | SEQ ID NO: 2326 |
| CD44 | ADXCRAD_CV026388_at | AATGCCTTTGATGGACCAATTACCATAACTATTGTTAACCGTGATGGCACCCGCTATGTC CAGAAAGGAGAATACAGAACGAATCCTGAAGACATCT | SEQ ID NO: 2327 |
| CD44 | ADXCRAD_CV026388_x_at | GTATGACACATATTGCTTCAATGCTTCAGCTCCACCTGAAGAAGATTGTACATCAGTCAC AGACCTGCCCAATGCCTTTGATGGACCAATTACCATAACTATTGTTAACCGTGATGGCAC CCGCTATGTCCAGAAAGGAGAATACAGAACGAATCCTGAAGACATCTACCCCAGC | SEQ ID NO: 2328 |
| PTRF | ADXCRAD_AL545542_at | GCTCCTTCCCTAGGAGCATGGGTGGCACGTGCC | SEQ ID NO: 2330 |
| PTRF | ADXCRAD_AL545542_x_at | AGGGTGCCGGCCCTGCCACCAAGTTGAGAGCTGGAGGGGAGGTGGGGAGAGAACATCACA GAGCAGCCAGCCCTGGTTCACTCCTGGSAGTTTCTTCTCAAGCTCCTTCCCTAGGAGCAT GGGTGGCACGTGCCTGTTGGTCTCAGC | SEQ ID NO: 2331 |
| MAPK1 | ADXCRAD_BQ889971_x_at | AAAAGTAGCCGGCCGTGGCGGTGTGCGCCTGTGG | SEQ ID NO: 2332 |
| SEPT7 | ADXCRAD_BF855173_at | AAGGTACTTAGAGCTCTTACTTTCTAAGTACAGAACACCCTAGACAATTCAAGGCATCTT AATCTCCATCAAGAACAAAAAAAAAATAATTTTGGTCATGCGGTTAAATCCATCATTAG GGATAAAACGGGTGCAAATGGGTCAAAGGGATCCAACAAACACGGATGTCCAAGCGGGCA TATGGGCAACTATTACGTTAACGGGGGGTCAATAGAGAGTTAAAAAGATCTTCCCTTTCT TCTGGTTCTTTTCCAGGGTTCTGGAAGAGTTCTGGT | SEQ ID NO: 2333 |
| PDLIM7 | ADXCRD_BU927740_at | AGGCAGGAAAAATCGCTTTGATCCTGAAAAGGTGG | SEQ ID NO: 2334 |
| WDR1 | ADXCRAD_CV811638_s_at | GGGACTAGAGTTTAACTGCAGCGGAACATGTCATTTCTCTATTTCTGTGACGCGCCCCA TGCCCCACCCCACCACAAGAGGCAGGAGGGCCCAGTCATGACCCTGCTCTCTGCAGGGT GTCTGTACACGTTCTTCTGAAAGCTTTAGACAGTAACAGTTTGCACATGAAAAATAAAGC GAGCACCTAAACAATGTGGTGGAGCATAACTAAAACCCACAGCCC | SEQ ID NO: 2335 |
| YWHAZ | ADXCRAD_BM461687_s_at | TGAATGGACTTTTCAACTACTTTCTCTACAGCTTTTCATGTAAATTAGTCTTGGTTCTGA AACTTCTCTAAAGGAAATTGTACATTTTTTGAAATTTATTCCTTATTCCCCTCTGGNCAG | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | CTAATGGGCTCTTACCAAGTTTAAACACAAAATTTATCATAACAAAAATACTACTAATAT AACTACTGGTTCCATGTCCCATGATCCCCTCTCT | 2336 |
| SPTBN1 | ADXCRAD_BI823572_s_at | TTAAGACTGATTCTGGAGGTCCATCAGTTCTCAAGAGACGCCAGTGTGGCCGAGGCCTGG CTGCTTGGACAGGAGCCGTACCTATCCAGCCGAGAGATAGGCCAGAGCGTGGACGAGGTG GAGAAGCTCATCAAGCGCCACGAGGCATTTGAAAGTCTGCAGCAACCTGGGATGAGAGG TTCTCTGCCCTGGAAAGGCTGACTACATTGGAGTTACTGGAAGTGCGCAGACAGCAA | SEQ ID NO: 2238 |
| CALU | ADXCRAD_BP380290_s_at | GAATGCTGATGGTTTCATTGATCTAGAAGAGTATATTGGTGACATGTACAGCCATGATGG GAATACTGATGAGCCAGAATGGGTAAAGACAGAGCGAGAGCAGTTTGTTGAGTTTCGGGA TAAGAACCGTGATGGGAAGATGGACAAGGAAGAGACCAAAGACTGGATCCTTCCCTCAGA CTATGATCATGCAGAGGCAGAAGCCAGGCACCTGGTCTATGAATCAGACCAAAACAAGGA TGGCAAGCTTACCAAGGAGGAGATCGTTGACAAGTATGACTTAT | SEQ ID NO: 2344 |
| FLNA | ADXCRAD_CN332899_at | TGACCTCTCGGCTTTCACTTGGGCAGAGGGAGCCATTTGGTGGCGCTGCTTGTCTTCTTT GGTTCTGGGAGGGGTGAAGGATGGGGGTCCTGTACACAACCACCCA | SEQ ID NO: 2347 |
| FLNA | ADXCRAD_CN332899_x_at | TGACCTCTCGGCTTTCACTTGGGCAGAGGGAGCCATTTGGTGGCGCTGCTTGTCTTCTTT GGTTCTGGGAGGGGTGAAGGATGGGGGTCCTGTACACAACCAC | SEQ ID NO: 2348 |
| EPAS1 | ADXCRAD_BQ228942_at | TTTCACTCTCCTCCGTCTGGTTTTGGCACTAGGTATTTCTAACGCCCGCGACACTAATTT ACAAAATGGGAATTTACCTGGCGAAAACTTGCCCACGGCTCACCCAAGCAAGGGGCCTTT TTTTCTGGAGATGGCTCCCTTTAATTATCCCCAATTTTTTAAAGGGACCCCACTTGGTTT AAGCCTGGTTTCTAAAAAGGTGCCTTAAAATTTGTGGAGGGATTTTTTTTCCCCCCCAC CCCTCCAAAGGGCTCTCCAGCAGTTCAAATTAGCCCGGCGGG | SEQ ID NO: 2349 |
| CD59 | ADXCRAD_CX784253_s_at | GAGCTAACGTACTACTGCTGCAAGAAGGACCTGTGTAACTTTAACGAACAGCTTGAAAAT GGTGGGACATCCTTATCAGAGAAAACAGTTCTTCTGCTGGTGACTCCATTTCTGGCAGCA GCCTGGAGCCTTCATCCCTAAGTCAACACCAGGAGAGCTTCTCCCAAACTCCCCGTTCCT GCGTAGTCCGCTTTCTCTTGCTGCCACATTCTAAAGGCTT | SEQ ID NO: 2353 |
| CD59 | ADXCRAD_CN431378_s_at | GATAGCAGGGCATGAAAACTTAGAGAGGTACAAGTGGCTGAAAATCGAGTTTTTCCTCTG TCTTTAAATTTTATATGGCTTTGTTATCTTCCACTGGAAAAGTGTAATAGCATACATC | SEQ ID NO: 2354 |
| CD59 | ADXCRAD_BP343697_s_at | TGCTAACTCCTAGCTGACTCAGCATAGATTGTATAAAATACCTTTGTAACGGCTCTTAGC ACACTCACAGATGTTTGAGGCTTTCAGAAGCTCTTCTAAAAAATGATACACACCTTTCAC AAGGGCAAACTTTTTCCTTTTCCCTGTGTATTCTAGTGAATGAATCTCAAGATTCAGTAG ACCTAATGACATTTGTATTTTATGATCTTGGCTGTATTTAATGGCATAGGCTGACTTTTG CAGATGGAGGAATTTCTTGATTAA | SEQ ID NO: 2355 |
| CKAP4 | ADXCRAD_CX752475_at | AGCAGATTACCTCAGAATCCTGTCTGGTGGCAGAATTCAGTAAAAAAAAAAGTGGGTGG GGGACCTTTCTTTCAGTGCTTAAGAAATATTTACTTTTTTGTCTGCGAATTTTGAATACC CATGCTCATTGACGTTAGCCAACGCCCTTATAGAGAGACTGGCTCTGAGATCCGTAGGCC CAGGCGCTCTCACTTGACAGATACCGGTAGG | SEQ ID NO: 2356 |
| RRBP1 | ADXCRAD_CB159041_at | TAAACACTATCCTGGGCGCAGCCCCGGGCCACCGCCGAGTGACGCCAAAGCCCTGGTTGA CTCTGACAGCCCCGTGGGTGTGTGGGAGGCCGGGCGCTCTGGGGTCTGTCTGTCAGT | SEQ ID NO: 2360 |
| RRBP1 | ADXCRAD_CB159041_s_at | AAAGCCCTGGTTGACTCTGACAGCCCCGTGGGTGTGTGGGAGGCCGGGCGCTCTGGGGTC TGTCTGTCAGTGCAATCGTTTAGTGTTTTTTCAGTGGGGCGGGGCGGGAAGCGGGTGGGA CCGGGCAGCCAGTTCTCAAAGGCTGTGGGGCCGACTGGAGGCCACAGCCCCTCACCCCTA GACGTTGCCAACCAGAACTGACGTG | SEQ ID NO: 2361 |
| RRBP1 | ADXCRAD_BQ778389_at | TGGTGGTGAGTTTTCGCCATCTCCTTGCGCTGGTTGGCTAGGGCTTCTTCATATGACGTT TCCTTCATGGAGAAAGTCGACACCAGGAAGATGCCAATGGCAGAAACAACCATGAATCCT CCAAAGACCACAACCCCCAAGGGTTTGAGTGTCGTAAATATCCATCCTGGCTTGCTTTC | SEQ ID NO: 2362 |
| RRBP1 | ADXCRAD_BQ931525_at | CCATGAGAGAACAAGTCTCCTTAGAGCCACAAGAAGTAGACCCTTCCCAGAGCCCCCAGT TTTGTAAAATGAAACCCTGTGCTCCCCATTTT | SEQ ID NO: 2363 |
| RRBP1 | ADXCRAD_BQ931525_x_at | CCATGAGAGAACAAGTCTCCTTAGAGCCACAAGAAGTAGACCCTTCCCAGAGCCCCCAGT TTTGTAAAATGAAACCCTGTGCTCCCCATTTTGGATAAACCACTAATCCCG | SEQ ID NO: 2364 |
| ATP1B1 | ADXCRAD_BP311263_s_at | GAAGTTAAGAGCTGATCACAAGCACAAATCTTTCCCACTAGCCATTTAATAAGTTAAAAA AAGATACAAAAACAAAAACCTACTAGTCTTGAACAAACTGTCATACGTATGGGACCTACA CTTAATCTATATGCTTTACACTAGCTTTCTGCATTTAATAGGTTAG | SEQ ID NO: 2367 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| FHL1 | ADXCRAD_CX872156_s_at | CACTTACCAGGATCAGCCCTGGCATGCCGATTGCTTTGTGTGTGTTACCTGCTCTAAGAA GCTGGCTGGGCAGCGTTTCACCGCTGTGGAGGACCAGTATTACTGCGTGGATTGCTACAA GAACTTTGTGGCCAAGAAGTGTGCTGGATGCAAGAACCCCATCACTGGG | SEQ ID NO: 2369 |
| PPP4R1 | ADXCRAD_BG291984_at | CCCACAGTACCGAGAAACACAAGAGGCACAACACACAAGACCAAGAACACAAAGGAGGC GGGCGCCACAAAGTAGACACCAAGCAGGAGGCGACAAGAACACAGGACCACAGAGTGTAC AAAAAGAGGCCCTACATAGCGACAGAAATACACGAGAGCAGACGGGCCCGAGATCACAC GCAGACGGCGAAAAGCAGAGTGGGGCCTGAGAAGACACATCCCGCGGGAGATCACAGACC A | SEQ ID NO: 2370 |
| MARCKS | ADXCRAD_CD110028_at | CAACGGCAGCGTCCCGGCCCGCCGAACAAAGAGGAAGCCCGCGGGCCGCCGGGAAGCGGG GGGCGGCCTTCACCCCTCCCTCGGGCCCGAAAAAGGGTGAAGTCGGGTCCCGCCGAACC GCCATGCCCTCCCTAAAGG | SEQ ID NO: 2374 |
| MARCKS | ADXCRAD_AV732105_at | GAATGTACTTTGCTTTACAAAATGCTATAACTCTGCTTAGGNGTCTATTTTCTTGAGCCA CTAAAGCGAAAATAATGT | SEQ ID NO: 2375 |
| MARCKS | ADXCRAD_AV732105_s_at | ATTTTAAACTCAACCAAGCTGTGATAAGTGGAATGGTTACTGTTTATACTGTGGTATGTT TTTGATTACAGCAGATAATGCTTTCTTTTCCAGTCGTCTTTGAGAATAAAGGAAAAAAA TCTTCAGATGCAATGGTTNTGTGTAGCATCTTGGCTATCATGTTTTGGAAATACTGGAGA AGCTTTGACCAATT | SEQ ID NO: 2376 |
| RYBP | ADXCRAD_BM931122_at | CTAAAGTGTCAGTTGGTGGTTTTGTGAACTGGTCAAAAATTCACAGGTCTTAAATGTTTT GGGGGAAATTTATATTGGACACTGCTCTTTGTCTAGCAAATAAAAGATGTTAATATATTC CTGTTACTGGCATGTGCACGACTATGTTATTAGAAGCCACTTTATCATTTTCCTGCTTTA AATAGAAATGTCTATTTATGAATTCTGCTTGTAGTTTTTTCAC | SEQ ID NO: 2378 |
| NR3C1 | ADXCRAD_CA392568_at | GTGCCTTTTATAGCTATTACTGTCTGGTTTTAACAATTTCCTTTATATTTAGTGAACTAC GCTTGCTCATTTTTTCTTACATAATTTTTTATTCAAGTTATTGTACAGCTGTTTAAGATG GGCAGCTAGTTCGTAGCTTTCCCAAATAAACTCTAAACATTAATCAATCATCTGTGTGAA AATGGGTTGGTGCTTCTAACCTGATGGCACTTAGCTATCAGAAGACCACAAAAATTGACT CAAATCTCCAGTATTCTTG | SEQ ID NO: 2379 |
| NR3C1 | ADXCRAD_BQ433598_at | GGTTACTTTCACATACAGCCCTCCCCCAGCAGTTGAATGACAACAGAAGCTTCAGAAGTT TGGCAATAGTTTGCATAGAGGTACCAGCAATATGTAAATAGTGCAGAATCTCATAGGTTG CCAATAATACACTAATTCCTTTCTATCCTACAACAAGAGTTTATTTCCAAATAAAATGAG GACATGTTTTTGTTTTCTTTGAATGGGCTTTTGAATGTTATTGTTATTTTCAGAATTTT GGAGAAATTATTTAATAAAAAAAACAATCATTTGGCTTTTTGAATGCTC | SEQ ID NO: 2380 |
| LDLR | ADXCRAD_CX873479_at | GAGGCAGAGCCTGAGTCACCGGTCACCCTTAATATTTATTAAGTGCCTGAGACACCCGGT TACCTTGGCCGTGAGGACACGTGGCCTGCACCCAGGTGTGGCTGTCAGGACACCAGCCTG GTGCCCGTCCTCCCGACCCCTACCCACTTCCATTCCCGTGGTCTCCTTGCACTTTCTCAG TTCAGAGTTGTACACTGTGTACATTTGGCATTTGTGTTATTATTTTGCACTGTTTTCTGT CGTGTGTGTTGGGGATGGGATCCCAGGCCAGGGAAAGCCCGTGTCAATGAATGCCG | SEQ ID NO: 2385 |
| CYP1B1 | ADXCRAD_BQ939150_at | CCGCGCAGCCGCCAAAGTCTCGAGGGCCACGTGCTGAGCGAAGCGCGCGAANCTGGTGGC CCTTCTGGGGGCCCGCANCGCGGACGGGGCCTTCCTCCGACCCAGGGCGCTGAACCGTCC TGGCCGTGGCCAACCTCTTGAATGGCCGTGGGGTTTCGGCTGGCGCTAACNCCCCAACAA ACCCCAAGTCCCGGGGAGTCGCTCCCCCACACAACAAAAAG | SEQ ID NO: 2391 |
| CYP1B1 | ADXCRAD_BX104039_s_at | AAAGCTGTGTTTATATGGAAGAAAGTAAGGTGCTTGGAGTTTACCTGGCTTATTTAATAT GCTTATAACCTAGTTAAAGAAAGGAAAAGAAAACAAAAAACGAATGAAAATAACTGAATT TGGAGGCTGGAGTAATCAGATTACTGCTTTAATCAGAAACCCTCATTGTGTTTCTACCGG AGAGAGAATGTATT | SEQ ID NO: 2392 |
| CRIM1 | ADXCRAD_CD101810_at | AAATAGAATTGACCTCCAGCCCGGATTAGGCATAAATTTTG | SEQ ID NO: 2396 |
| CRIM1 | ADXCRAD_CD101810_x_at | GGTGTTCTACCTGTTTGCATCAAAGGAAAAAAAGATTTTTTTTCCAAGGGCCAATTTTTT TATCTTTTCCCAAAAAAAATTTGTTAATGGAACATTTACAAAAATAGAATTGACCTCCAG CCCGGATTAGGCATAAATTTTGGTTGGGA | SEQ ID NO: 2397 |
| ACTB | ADXCRAD_CD514490_x_at | CACCCCACTTCTCTCTAAGGAGAATGGCCCAGTCCTCTCCCAAGTCCACACAGGGGAGGT GATAGCATTGCTTTCGTGTAAATTATGTAATGCAAAATTTTTTAATCTTCGCCTTAATA CTTTTTTATTTTGTTTATTTTGAATGATGAGCCTTCGTGCCCCCCCTTCCCCCTTTTTT GTCCCCCAACTTGAGATGTATGAAGGCTTTTGGTCTCCCTGGGAGTGGGTGGAGGCAGCC AGGGCTTACCTGTACACTGACTTGAGACCAGTTGAATAAAAGTGCACACCTT | SEQ ID NO: 2399 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| LPP | ADXCRAD_BM456598_at | TTGTCTTGGAAGTATCTCATAGGTCTTTAAATGAGTAAAACATTTTTATGCCAGAAGGTG ATATAATGGATGTTAGTGTTTTTTATTGGATTTTACAGGAGTTTTAGTCAGATAATGAGG ACAGAGACCTCCACTTGAATTCTTTACCACCATTTCAGCAATATTTTTTAATGGCCTTT CACTTGGATTTTGGCTTAAATAAGGGCCCCGAACAAGATCCAAAACTTTGTGTCCTCAGG GAAGGGCCATTAATA | SEQ ID NO: 2400 |
| LPP | ADXCRAD_BM456598_x_at | TTGTCTTGGAAGTATCTCATAGGTCTTTAAATGAGTAAAACATTTTTATGCCAGAAGGTG ATATAATGGATGTTAGTGTTTTTTATTGGATTTTACAGGAGTTTTAGTCAGATAATGAGG ACAGAGACCTCCACTTGAATTCTTTACCACCATTTCAGCAATATTTTTTAATGGCCTTT CACTTGGATTTTGGCTTAAATAAGGGCCCCGAACAAGATCCAAAACTTTGTGTCCTCAGG GAAGGGCCATTAATA | SEQ ID NO: 2401 |
| LOXL2 | ADXCRAD_CF619371_at | CCATGGTGGGTCTGCCCGCCAGCTGGGCCTTGGGAATTCGCCCACCAAACGCCTTTCAAG AAAACCTTGGTTATTGGGCCCCGGAAGATGTTCAACAGCCCAACAA | SEQ ID NO: 2405 |
| BCL6 | ADXCRAD_BM454297_at | GCGCCCCTTTTTTATGTGACGAGCAAAACCCTCCTTTCTCCCTG | SEQ ID NO: 2406 |
| FNDC3B | ADXCRAD_CK126145_at | TTTCATAGTGTCACCTAATCTGCGTAAAGCCGCCGCTTCCTTTATGAGGGTAATGCTTCA GCAACTGATAAATACTTGATGGTTGGACAACCCACTAAAGCATGAAAATGTTTTTGGAAT TGGAGCATGCTTATGACCTAAACGCAAAAATTAACACATGCTCTTTTTTCGT | SEQ ID NO: 2409 |
| CAV2 | ADXCRAD_BM804910_at | TAAAAACAAAACCGTGCGCATTGTGGGCCCCCCTTT | SEQ ID NO: 2412 |
| ELF4 | ADXCRAD_AW970249_at | CCAGTTTATTAATGCCAGTTTCCCGATGGTTGGAAAGGAACCATTTTG | SEQ ID NO: 2415 |
| EPHA2 | ADXCRAD_BU174123_at | GACAGAGGGTGTCAAACATTCGTGAGCTGGGGACTCAGGGACCGGTGCTGCAGGAGTGTC CTGCCCATGCCCCAGTCGGCCCCATCTCTCATCCTTTTGGATAAGTTTCTATTCTGTCAG TGTTAAAGATTTGTTTTGTTGGACATTTTTTTCGAATCTTAATTTATTATTTTTTTTATA TTTATTGTTAGAAAATGACTTATTTCTGCTCTGGAATAAAGTTGCAGATGATTCAAA | SEQ ID NO: 2416 |
| CDC42BPA | ADXCRAD_BM048315_at | CTTTATAAGAGATCCTCTGTACCAAAACAATGA | SEQ ID NO: 2417 |
| CDC42BPA | ADXCRAD_BM048315_s_at | ATGAAAACAAAATGACTTGTCTTTTTATTTGATAGTGTAATATCATTCATTTTATAAATT TTTTAGGGTTTTTCTCGTTGTAATATTGTACAGTTTTGCATGGCCTGGTGTGATCATTTT TTGGTTAGAATAATGCTGACAAATGTGGATGGAGGGGAAGATACTGTTTAGCCTATCA CTCCTTATTTTATTTTGTTTGGTTTTATGCCCTCAGTG | SEQ ID NO: 2418 |
| PHACTR2 | ADXCRAD_BX119839_s_at | AAGTCAGATGTAATGTGACCCTAGAAAACTGTAGCAAGCTTCAGAAATAAATCTTTTGAT CTTTCCCTATCTTGATTAGATCCAAAGTCAAAGCAACCATACTTCACCTAGAGAAGACAG TATTGGCAATCATGACACCTGTAATAAAAACTTGAATCCAAAGTCAAAACTTAAGCAAGA TACAAATGTGCTGCCTGCAGTTAGTCCTGCATGGGAATAAGGACTAGTTAT | SEQ ID NO: 2420 |
| ULK2 | ADXCRAD_CK818454_s_at | AGTTGGTGACCTAAAGGCTTGTTAGTGATGTGGAGTTCCTACATGCAGTGAGTGGAAAAT GAAGTTCGTTTTCTCTTAGGAAAATGGGCAGCTGTCTTCTGCCTAATGTGTATTTTTCAT GTTAATTCTGACAGTTCACCAAATAGCTAGTCATGGAGAATGCAGGCAGTTAACTTAATA TCCCTCCAGGAATGGTTCTACGTTGTGTATTATTTGGTTTCTTTTACTTACCTGCTTGAA TACT | SEQ ID NO: 2421 |
| AURKA | ADXCRAD_BM790362_at | GCCCTGACCCCGATCAGTTAAGGAGCTGTGCAATAACCTTCCTAGTACCTGAGTGAGTGT GTAACTTATTGGGTTGGCGAAGCCTGGTAAAGCTGTTGGAATGAGTATGTGATTCTTTTT AAGTATGAAAATAAAGATATATGTACAGACTTGTATTTTTTCTCTGGTGGCATTCCTTTA GGAATGCTGTGTGTCTGTCCGGCACCCCGGTAGGCCTGATTGGGTTTCTAGTCCTCCTTA ACCACTTATCTCCCATATGAGAGTGTG | SEQ ID NO: 2422 |
| F3 | ADXCRAD_BU941055_at | GGAATTGTTACTGGTGTACTTATTCTATCTTCCATTTTATTATTTATGTACAATTTTGGT GTTTGTATTA | SEQ ID NO: 2425 |
| F3 | ADXCRAD_BU941055_x_at | GGAATTGTTACTGGTGTACTTATTCTATCTTCCATTTTATTATTTATGTACAATTTTGGT GTTTGTATTAGCTC | SEQ ID NO: 2426 |
| LDOC1 | ADXCRAD_CN356531_s_at | GCCGTTCAGCCTGGTTAGTTTTCTACCTACTCCGAGTGTCCTCCCCTGCCCCACCAGATT GCTGCAGGGGCGCGGTGTGCCTGGCAGCCAAATTGTTGACACTTCTTTTTTCCTATGCAC TGGTTTTACACAGCTGTCATTTTTCTTTCAAAATTGCAGCAGTCCCACAGATGTGTGCAT | SEQ ID NO: 2427 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | TTGGACAAATAGTACTTAAAAACAAAACAAACAAGCACTCAGCCCAGCTCCTCAATACTACCTGGAAAAGCATTGGCA | |
| CD44 | ADXCRAD_BP233968_at | TGAATGGGTCCATTTTGCCCTTCCATAGCCTAATCCCTGGGCATTGCTTTCCACTGAGGTTGGGGGTTGGGGTGTACTAGTTACACATCTTCAACAGACCCCCTCTAGAAATTTTTCAGATGCTTCTGGGAGACACCCAAAGGGTGAAGCTATTTATCTGTAGTAAACTATTTATCTGTGTTTTTGAAATATTAAACCCTGGATCAGTCCTTTGATCAGTATAAT | SEQ ID NO: 2428 |
| PPIC | ADXCRAD_AL540607_s_at | GAAAAGTCATTGATGGGATGACAGTGGTGCACTCCATAGAGCTCCAAGCAACTGATGGGCATGACCGTCCACTCACC | SEQ ID NO: 2429 |
| IL6ST | ADXCRAD_AV662263_s_at | CTGATGTAAGTGTTGTGGAAATAGAAGCAAATGACAAAAAGCCTTTTCCAGAAGATCTGAAATCATTGGACCTGTTCAAAAAGGAAAAATTAATACTGAAGGACACAGCAGTGGTATTGGGGGGGTCTTCATGCATGTCATCTTCTAGGCCAAGCATTTCTAGCAGTG | SEQ ID NO: 2434 |
| SPTBN1 | ADXCRAD_CX872934_at | ACTAGAATTATCTCAAACGTACAATATAATGTATTTCAGCAAAAAAAAAAAAAATTGAAATTACAGATTATTTAAAACAGTATCAGTTTTCTATTCCTTCTTGTATACCGACATTCTTAACCGTCATAGCAGTTGATGCAAAAAAGCCGCATGTCGTGTGTTAGTAAGTGATGCCAGATACAAATGGTTTGGTCTGTAGAGTTAATGTGGAGCTGCACTGTGGCTGCAGCAAGATCATAATATGCGATCTGTTTAATAAAGGTTAGCC | SEQ ID NO: 2437 |
| FOXN3 | ADXCRAD_BP254636_s_at | CATCTTGTGGCTCCCCAGTGGTCAGCGGAGACCCCAAGGAGGATCACAACTACAGCAGTGCCAAGTCCTCCAACGCCCGGAGCACCTCGCCCACCAGCGACTCCATCTCCTCCTCCTCCTCCTCAGCCGACGACCACTATGAGTTTGCCACCAAGGGGAGCCAGGAGGGCAGCGAGGGCAGCGAGGGGAGCTTTCGGAGCCACGAGAGCCCCAGCGACACGGAAGAGGACGACA | SEQ ID NO: 2438 |
| MXRA7 | ADXCRAD_BX099460_at | TGATCACCCCACTGGCAGGACAATTCACAGTTCTTGAGCAAACTGAGTTAGGGAGGGTATGCTAACGACAGAACCTATGCAAGTTCTTAGAAATATTTTTGTTTGCTGAAATAAAGCTCAATCAACACACTACCTTAAAAAAAGTGGGAGCAGTGGCATTTCCATGCCTCATGCTCACCATCATGAGGTTAACTTCCCGCCGTCGCCTCTTGCCTGCCAGGGGTTTTTCGGGAGCCCCTCTCTGTTCCACTCTGATTCCTTTTGNTTCTTTGCTGACCATTCACTCTCTG | SEQ ID NO: 2442 |
| NT5E | ADXCRAD_BM704188_at | GGAGAAAGCTCCCTCCGTTCTGATGCTTTTGAGCTTATCAGGGACACCCTGCAGCAGAAATTCCAGCTGATCCTTCAGCCTTCAGAGTTGATGAGGTGGGGCTCACACACATCTGGATTTGAAGAAGAATCGTGGGTTTCAAGAACTCTGTGGTCTCTTAAGCATTGGTATTCCACAGCTACACTTCCCTGATACTTTGCACTCAGTAATGACAA | SEQ ID NO: 2446 |
| PHACTR2 | ADXCRAD_CA944993_s_at | GTGGGTATAAATATCTACAAGTATACACACATATGTACTTGTATTCCACTATTGTAACCTGAAAGAAAGACTATGTATTCCCTTTTTTAATTCCGTACTGGTATTTGTGTTATTTAAAAGCAAAATTCTGCTCTATTTAGTTGTATAATATTAGAGGATACTTTGCTGTGCACAATTCCA | SEQ ID NO: 2451 |
| CRIM1 | ADXCRAD_AI651806_s_at | ACATTTTCTTTTCACGTTAAGCATACTGGGTATCTGTGTCTTTCACAACAAGCATTTTTAAAAGAAAACTCAATGCACAAATGGGTTAATTAGTATAAAAGTGCTAAGGGCTGTTTGAAAAGTTACCACTATAGTATACAGTCAGTTATATTTGAGGCATACTACAACAAACTTCCAGCTTATTGTGGACAATATTCCAGTAGTTGTTTCAAACCATTGTTTGAAAAAAAAAAAAAAAATCCAGGAGCTGATTAGTGATGCAG | SEQ ID NO: 2454 |
| CDH11 | ADXCRAD_BG435621_at | ACAAACTAGTGGTGGGGGCACAGCAGAGCCCACGAAAAGAAGTTTTGT | SEQ ID NO: 2458 |
| CD44 | ADXCRAD_BM840380_s_at | GAGATCACTTCCAGCCTAATGTGCATTTGGCTGGAATATGGTTGTCTCAGAATAACATCATGCACTCGGGCTTTTATACTTCTGCCTTTAGGGGACTGTGGCAGCATGGCATGGGTCAAGAAGTACTTCTCCTTCATCTTCCTTTGATGTCGGTAACTCATCCTTTCTGCACTGCGGGAGTTGTTAATGCTTTTGTGTCCTCCAGTTCACATGCTGATTGCTAAGAAGAAAATGAGCATGAGTGAACCCAAAGCTGCTGAAACATTCTGCGTTTATGCAACTTCCTTG | SEQ ID NO: 2459 |
| P4HA1 | ADXCRAD_CD013931_at | ATGACAGATGATTTTGTTCAGGAATTTTGCTGTTTTTCTTAGTGCTAATACCTTGCCTCTTATTCCTGCTACAGCAGGGTGGTAATATTGGCATTCTGATTAAATACTGTGCCTTAGGAGACTGGAAGTTTAAAAATGTACAAGTCCTTTCAGTGATGAGGGAATTGATTTTTTTTAAAGTCTTTTTCTTAGAAAGCCAAAATGTTTGTTTTTTTAAGATTCTGAAATGTGTTGTGACAACAATGACCTATTTATGATCTTAA | SEQ ID NO: 2463 |
| PRSS23 | ADXCRAD_BU164591_at | AAAAAACTGGGCTGTTCAATCTCCTTTCCATTTTTAAAAACCTATTTTGAAAAAGCTAAAAAAAACTATTATGGCCTCCCTTTAGGGGGGTTTATTTTTAATCCCCGCTTTTTTATTCACTTTTTAAAAATTAAAAAGTTAAAAAAAAAATGGAAGCACCCCTGGCTAAAAAT | SEQ ID NO: 2464 |
| ZNF264 | ADXCRAD_BM504879_s_at | GTGTGTGTACATATGGACCACTTCAAGCTACACACACACACACACACATATACACGTGTATGAATATATATATGGCTATAAGTGGTGCGACTTGCAGGTACTCCCTTTGTTCACCTTTGTAAAGATGTTATTGCCAGTTCAGTGTGTATTTCTATAGTATATATGTAAACAATTTGTCATCCTTTTGTTGCTGCTTTTGAAACTAGTTCATGGCTTCAGTGG | SEQ ID NO: 2465 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| MALT1 | ADXCRAD_BU164882_s_at | ATTTTAGTAGAAGTAATGTGCCAGTAGAGACAACTGATGAAATACCATTTAGTTTCTCTG ACAGGCTCAGAATTTCTGAAAAATGACCTCCTTGTTTTTGAAAGTTAGCATAATTTTAGA TGCCTGTGAAATAGTACTGCACTTACATAAAGTGAGACATTGTGAAAAGGCAAATTTGTA TATGTAGAGAAAGAATAGTAGTAACTGTTTCATAGCAAACTTCAGGACTTTGAGATGTTG AAATTAC | SEQ ID NO: 2466 |
| FLNB | ADXCRAD_BP358943_s_at | TGCTATAGCGCCATTCCCAAGGCATCCTCGGACGCCAGCAAGGTGACCTCTAAGGGGCA GGGCTCTCAAAGGCCTTTGTGGGCCAGAAGAGTTCCTTCCTGGTGGACTGCAGCAAAGCT GGCTCCAACATGCTGCTGATCGGGGTCCATGGGCCCACCACCCCCTGCGAGGAGGTCTCC ATGAAGCATGTAGGCAACCAGCAATACAACGTCACATACGTCGTCAAGGAGAGGGGCGAT TATGTGCTGGCTGTGAAGTGGGGGGAGGAACACATCCCTGGCAGCCCT | SEQ ID NO: 2468 |
| ACTN1 | ADXCRAD_CX871590_s_at | TCTCCTGCCTGGGTTCGGTTTCAGCTCCCAGCCTCCACCCGGGTGAGCTGGGGCCCACGT GGCATCGATCCTCCCTGCCCGCGAAGTGACAGTTTACAAAATT | SEQ ID NO: 2469 |
| PTRF | ADXCRAD_BU186765_at | TTCCATTGAACCCAAAGGTCCGCAACACCTGCCTCCCAGGCCTGGGGCGGAAAAAATTGA ACACCTCCTCTCCACCTTGAATGGGAGCCTTCAAGGG | SEQ ID NO: 2474 |
| PTRF | ADXCRAD_BU186765_x_at | TCTACTAAGCCGAAACCCATCTCTACTAAAATTACCAAAATTTNCCTGGGCATGATTGCG CATGCCTGTAAATCCAGCTACTTTTGGAGGCTTGAGGGGGGCAGCAATTGCTTGAACCTG GGGAAGGGGGCAGGTTTCCATTGAACCCAAAGGTCCGCAACACCTGCCTCCCAGGCCTGG GGCGGAAAAAATTGAAACACCTCCTCTCCACCTTGAATGGGAGCCTTCAAG | SEQ ID NO: 2475 |
| FOXN3 | ADXCRAD_BM995629_s_at | CCGTGTAGGTCTATTGGCCAGCCAAGGTCGAGACGACCCTAAGCATCAATAGTAAACCTCT TGGTCTTCTGATTGCTTTATCACTTTTTTTTTTTCTGTAAAACAAAACAAAACTCAGA AATGTTACAGAATCAGAGTATTAAAAAATGTACAAGTGTATATGCTTCCCAGACACACAT GGATACATTTTTCCTCCACATTTTCACCATGGCAGTATTAAGTAGTGAGTGTGAATGACA CAGCATGAAACTGGTTACTGAATCAGCTATGAGCTCAGATGGCCTCAAC | SEQ ID NO: 2480 |
| TUBB6 | ADXCRAD_BP390113_at | AACAGCAGAGAATTGCGGGTTCTACCCAGTCAGAAGATCACACCATGGAGACTTTCTACT AGAGGACTTGAAAGAGAACTGAGGGGCCACAAAATAAACTTCACCTTCCATTAAGTGTTC AAGCATGTCTGCAAATTAGGAGGGAGTTAGAAACAGTCTTTTTCATCCTTTGTGATGAAG CCTGAAATTGTGCCGTGTTGCCTTATATGAATATGCAGTATGGGACTTTGAAATAATGAT TCATAATAAAATACTAAACGTGTGTCTTCAA | SEQ ID NO: 2491 |
| NFIB | ADXCRAD_BX442437_at | TACAACAAAGTGACATCACTACACTTGTTTTGCTGCATTTATTATCATTTTAAATCTTTA CCATTTTTATGACAAAATATTTTGTACTCCAGACGAAGAAAATGTGTGACATCATGGAT TTTTTAGACAGTTATACCTTTATCTCMCATTTATAAAGCATATCATGGCTGTGTATAGTT GC | SEQ ID NO: 2492 |
| NFIB | ADXCRAD_BU902064_at | ATGTTGGTTTAACTGCACCCTCCTGNAGGTAGATTTATTTATTAAAAATACTGGTTGCAT CAAGACCCATAGGGTGTACAAAAGGTCTATAAAATCTGCATTATAGAGAAAAAGAGGCAN GCAAATCCATGTCCCAAGGTAAAAGCTACAGTTTACAACTGGGAACCCCAGGGTGAAGAT ATAAAACCCCTCTTGAAAACAAATTGAAACAGGGGCTGAAAACTTGCGTGGGGCTTCAA AATTACCCTGGTCAAATTTCCTGATTG | SEQ ID NO: 2493 |
| GRB10 | ADXCRAD_BG258819_at | AAGATCAGCGGAAACGTTGAAATAACTGGAATGATCATCTGGGGTGGGCCGCTACGAAC AGAACCGCAAACAGGATGGCATGAATCTTGCCCTGGATATCTGACATTACACGGACTGTC ACTAACGATGACACC | SEQ ID NO: 2496 |
| FHL1 | ADXCRAD_BP361024_at | GACTGTGTCAAGAGTGAGCCACCCAGTCTCTAAAGCTAGGAAGCCCCAGTGTGCCACGG GAAACGCTTGCCTCTCACCCTGTTTCCCAGCGCCAACCTCCGGGGCAGGCATCCGGGTGG AGAGAGGACTTGTCCCTCGTGGGTGGTGGTTCTTTATAGAA | SEQ ID NO: 2502 |
| ACTB | ADXCRAD_BM476291_at | CCCAAGTCACACAGGGGAAGGTGATAGCATTGGCTTTCGGGGAAATTATGTAATGCAAAA ATTTTTTTAAATCTTCGGCCTAAATACCTTTTTTAATTTGGGTTTTATTTTGAATGGAGG AAGCCTTTCCTGC | SEQ ID NO: 2504 |
| ACTB | ADXCRAD_BM476291_x_at | CCCCACTCTCTCTAAAGAGAATGGCCCAGTCCTCTCCCAAGTCACACAGGGGAAGGTGAT AGCATTGGCTTTCGGGGAAATTATGTAATGCAAAATTTTTTAAATCTTCGGCCTAAAT ACCTTTTTTAATTTGGGTTTTATTTTGAATGGAGGAAGCCTTTCCTGCCCCCCCCCTTTCC CCCTTTTTTTGTCCCCCCAACTTGAGAAGGATTGAAAAGCTTTTTGGC | SEQ ID NO: 2505 |
| WDR1 | ADXCRAD_BE740367_at | ATACCGGCTGGCCACGGGAAGCGATGATAACTGCGCGGCATTCTTTGAGGGACCCCCATT CAAGTTCAAGTTCACAGTTGGCGACCACAGCCGCTTGTCAACTGTGTGCGATTCTCTCCT GATGGGAACAGATTTGCCACAGCCAGTGCTGACGGCCAGATATACATCTATGACGGGAAG ACTGGGGAGAAGGTGTGCGCGCTGGGCGGAACAAGGCCCACGACGGTGGGATTTACGCA ATTAGTTGGAGTCCCGACAGCACCCATTTGCTTTT | SEQ ID NO: 2506 |
| GRB10 | ADXCRAD_BI833263_at | GGGCGCGGCGCCAAAAAGCAGACCCCGAAGAGAGAGCCGCATAGGCACAAGAGGCCACAG CCAGATACCAACGGACAACAAGCTGGGCAAACAAATGGCGACACGACCGACGAAAAAAC CACGAGGAGACACAGCCAACCCAGACGACAAACCCGAGACACGCCGCCCACAAGACAGGG | SEQ ID NO: 2507 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | AACCACAAGCACCCCGACCGGGAGGCACACTCAAAGGACGCCGCACCCACCCACACAGGC AGGAGAGCGCCGACCGCGGCAACAAGAGCACCCAGA | |
| IL6ST | ADXCRAD_AU280467_s_at | GATAACAGTTACTCCAGTATATGCTGATGGACCAGGAAGCCCTGAATCCATAAAGGCATA CCTTAAACAAGCTCCACCTTCCAAAGGACCTACTGTTCGGACAAAAAAAGTAGGGAAAAA CGAAGCTGTCTTAGAGTGGGACCAACTTCCTGTTGATGTTCAGAATGGATTTATCAGAAA TTATACTATATTTTATAGAACCATCATTGGAAATGAAACTGCTGTGAATGTGGATTCTTC CCACACAGAATATACATTGTCCTCTTTGACTAGTG | SEQ ID NO: 2508 |
| CASK | ADXCRAD_AW959845_s_at | CTACATTCCGTTCATGGGGCACACCCAGGGGAATAAGAATAAAATGCTATTATGACTAAG TTGTAAACCTATGCACATCCCTTGCATTTTGGGCAACTTTAT | SEQ ID NO: 2509 |
| NFIB | ADXCRAD_BP382229_s_at | GAAGTCCAAGCCACAATGATCCTGCCAAGAATCCTCCAGGTTACCTTGAGGGTAGTTTTG TAAAATCTGGAGTCTTCAATGTATCAGAACTTGTAAGAGTATCCAGAACGCCCATAACCC AAGGAACTGGAGTCAACTTCCCAATTGGAGAAAT | SEQ ID NO: 2510 |
| VEGFA | ADXCRAD_AI557291_at | ATCCAGAAACCTGAAATGAAGGAAGAGGAGACTCTGCGCAGAGCACTTTGGGTCCGGAGG CGAGACTCCGGCGGAA | SEQ ID NO: 2511 |
| VEGFA | ADXCRAD_AI557291_s_at | ATTCCCGGGCGGGTGACCCAGCACGGTCCCTCTTGGAATTGGATTCGCCATTTTATTTTT CTTGCTGCTAAATCACCGAGCCCGGAAGATTAGAGAGTTTTATTTCTGGGATTCCTGTAG ACACACCCACC | SEQ ID NO: 2512 |
| LAMB1 | ADXCRAD_CN388523_s_at | GAAACCTTGTTCAACGCGTCCCAGCGCATCAGCGAGTTAGAGAGGAATGTGGAAGAACTT AAGCGGAAAGCTGCCCAAAACTCCGGGGAGGCAGAATATATTGAAAAAGTAGTATATACT GTGAAGCAAAGTGCAGAAGATGTTAAGAAGACTTTAGATGGTGAACTTGATGAAAAGTAT AAAAAAGTAGAAAATTTAATTGCCAAAAAAACTGAAGAGTCAGCTGATGCCAGAAGGAA | SEQ ID NO: 2513 |
| PLAU | ADXCRAD_CX787154_at | AGAGACTGGGAAGATAGGCTCTGCACAGATGGATTTGCCTGTGCCACCCACCAGGGTGAA CGACAATAGCTTTACCCTCAGGCATAGGCC | SEQ ID NO: 2514 |
| PLAU | ADXCRAD_CX787154_s_at | GCCAGGCGTCTACACGAGAGTCTCACACTTCTTACCCTGGATCCGCAGTCACACCAAGGA AGAGAATGGCCTGGCCCTCTGAGGGTCCCCAGGGAGGGAAACGGGCACCACCCGCTTTCTT GCTGGTTGTCATTTTTGCAGTAGAGTCATCTCCATCAGCTGTAAGAAGAGACTGGGAA | SEQ ID NO: 2515 |
| MDFIC | ADXCRAD_BE878413_at | GGACACCATAGCAGACAAGATAAAGAGGCAAGAAATTGTCCACGATCAAAAAGAGACTAT ATACGACAGTGAGAAAGAGGGTAGCCTATAAGATAGCAAAGAGGGGTGACAACAATCTA TTAATGAACAATATTTAACAGAGGGAGCACAAATAGCAGGATAAAACAACGGGTGAGAAT AAAAAAGTGGAGTAGAAAAAGAGATTAGTAGTACGAGAGAAAATAGGGGTGGAAAACCCA CAGTAATAGAACAA | SEQ ID NO: 2516 |
| ZFP36L1 | ADXCRAD_BU073871_s_at | AATATATTATTCTTCAACGACATTTTTTGTAACTTTACACTTTTTTGGTTATTTTATTTT AAAAAAATGAAAAATTAATTTAAAAAAATGCAAAAACTGTTGGATTATTTATTTTAGAA ATTCCCCCCTTTGTGTTGGACTGCAAATTGAGTTTCTTTCTCTTTAGGCCTTTCACAACT AGGACTGAGAATGTATGTAAAAGTTCTGTGACAGTACAGAAGGAAAACAACTTTTTATGT ATAGCTTCTA | SEQ ID NO: 2519 |
| LMNA | ADXCRAD_BI770050_at | AGAGAAGTTATTTTCGTACAGGTGGTTTTATACCTGAAGGGAATAAACGACAATGCAAAA ATAAACAGATCCGAGCCTCTATCTCAGTACATGTTGTCAGGCCGATAATGTCCGACCTCG CGTTTCGTTTTGCCCGTGTTTCCCGTGAAGCGTCGGAATTCGGCCTTGAAAACCAATAAG GGAATTCCTTTAGAAGCCAGGGCTGAAAGGGGTAGCGTAAGTAAAGAGGTCAACCTGCGA GGTATCATGACCTTGTAGGTTGGCCCGC | SEQ ID NO: 2520 |
| COL6A1 | ADXCRAD_CX781062_at | GGGCTCAGCCCTGAGTTGGCATCACCTGCGCAGGGCCCTCTGGGGCTCAGCCCTGAGCTA GTGTCACCTGC | SEQ ID NO: 2521 |
| CDC14B | ADXCRAD_BM842156_at | ACGCCCGGGAACACACACTGTGCTGGGGAGGAAGTGGGCCTAGGAGGGCCTGCAGGTCCA GGCAGCTGTAGAGCTGCTAGAAGCTGGGGTGTTGCTCTCCCCGCTTTCTCATAGACACAG AGGTACTGTCTGCCTGTTGTCACACAGTTCATATGCTCGCTTGAGATGGAATCTGAACCT TGGTCCCAGGATCTGTGCTTTTTCCCACTTTGCCACACTGTCTAAGGTGGCTTTGAACTG GAACCCAAGTGCAAATAAAGGTTGGTATTCGCTCCT | SEQ ID NO: 2522 |
| ATP2B4 | ADXCRAD_CN299966_at | ACAAATGGTGATATCAAAGCAACGTATACCCCAGTCCAGTGTGTGTTGCCATAATTTGCA ATTCAGCTTAACAGTGCACCCAATCTATATTTGCATTTTG | SEQ ID NO: 2523 |
| IGFBP3 | ADXCRAD_CD512795_at | AGCTCTTTAAAGGGCAAAAGCTTATTTCCACTNCTCATCCTTTTGTCCTCCTTTAGCACA ATGGTAAAAAGAATAAGTAATATCCGAACCAGGGAAGGGAGGGAATGGGCTTTGTCTGG GGGAAGCCCAATCCAGGGACAA | SEQ ID NO: 2524 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| IGFBP3 | ADXCRAD_CD512795_s_at | GACAGGGAGAGTCAGCCTCCACATTCAGAGGCATCACAAGTAATGGCACAATTCTTCGGA TGACTGCAGAAAATAGTGTTTTGTAGTTCAACAACTCAAGACGAAGCTTATTTCTGAGGA TAA | SEQ ID NO: 2525 |
| KCTD12 | ADXCRAD_BQ881289_at | TTTGTTTAATACATGTGGACCATGAACAGTATTCATTCTCCTTTTTCAATGATATGCTGT AGAAAATATTCCTTGAAGATGTGAGATTTAAAAATTTTTCCCTTTCAATGTTGGTTTAAT TGAATTTCCTAACTTGGGTTTTTTTGATTGATAGCCCAGTGATAAATCCTAATACTAGAC AAAATTTGTCTTCTCTTTTTCAACCAGAGCCCAAATATAATGGCCTGGAATAAAGGGGAA CCTTACTGCCTTCTCTTTGA | SEQ ID NO: 2526 |
| KCTD12 | ADXCRAD_BQ881289_x_at | CATGTGGACCATGAACAGTATTCATTCTCCTTTTTCAATGATATGCTGTAGAAAATATTC CTTGAAGATGTGAGATTTAAAAATTTTTCCCTTTCAATGTTGGTTTAATTGAATTTCCTA ACTTGGGTTTTTTTGATTGATAGCCCAGTGATAAATCCTAATACTAGACAAAATTTGTCT TCTCTTTTTCAACCAGAGCCCAAATATAATGGCCTGGAATAAAGGGGAACCTTACTGCCT TCTCTTTGAGGAAA | SEQ ID NO: 2527 |
| MAPK1 | ADXCRAD_CX757452_at | TTCAGTGTTGCTTTCCTCTTGATCAGCGTGTCTGAATGACAGTCAGGTTCAGGTGTGCTG ACACAGAATGCTCACAGGCTCACTTGCCG | SEQ ID NO: 2531 |
| RRAS2 | ADXCRAD_CX788826_at | GTTTGCCAAGCTGAAGCTACAGGTTGTGAAATAATTTTTAACTTTTGGAATCATACTGCC TACTGTTACTCTAAATAGAAATATAGGGTTTTTTTTAATGTGAATTTTTGCCTATCTTTA AACATTTCAATGTCAGCCTTTGTTAACCTTAAATACACTGAATTGAATCTACAAAAGTGA ACCATCTCAGACCTTTACTGATACTACAACTTTTGTTTTCTGATGGCCAAAATACCAAAT GCCTGTTGTATTTATGGATTAAA | SEQ ID NO: 2536 |
| ARID5B | ADXCRAD_BG285011_at | CTCTATGCTCTGTAAGGTGATTATTTGTATATAGCAACATGGCCCAGTGATATTATATAG TTTCCCAATGGAGAGGTTATTGAGTAACCTTTGCATTAGTTTAAACACTACCAGAAGAAT GCTGAGCCAACTATAAACACTCAATTTTGTATGTTTTCCAAATTGGTACTTATTACTGCT TTTGATACTGTATTACGTGCCAATAGTTTCCCAATCACATAGCAGGCAAGAGATATTTTG TACTTTCTGATCCACTGTAATATTTA | SEQ ID NO: 2537 |
| NFIB | ADXCRAD_CA430617_at | GCCTGTTCAATTTCACAGTCTCTGTTGAGTTCAGTTGTAAATATGTTTCAAATGACATTT TCTTGGGAAAAAAAATCTCTACAACATTGTAGAATGTGAGGGGTAACTACATCCCAGGCA TAGGTTTCTCAAAGCTGCAGTAGATTATGTCTTCATCAAGCTGTTAATTTGTGCTTATAT CATATAGAACTTTTAGCATCCTG | SEQ ID NO: 2542 |
| NFIB | ADXCRAD_BQ068224_s_at | TATGGCTTTTTATGCATCCTTCATCGAGGGCATTGAAGTTGCATGGACTGATAAAAGTTG ATGCNAAACAAGAAAGAAACAAACAAAAAAAAAAAAACCAGCAAAATGTTTACCCAAAAA CTCAAACAAATGAGCAGTGCCTGTT | SEQ ID NO: 2543 |
| CREB3L1 | ADXCRAD_BM850478_at | CCCACTGTACAGAGACCAAGAACAGAAATTGTTTGTAAATAATGAACCTTATTTTTTATT ATTGCCAATCCCCTAAGATATTGTATTTTACAAATCTCCCTCTTCCCTTCGCCCCTCCCT TGTTTTATATTTTATGAAGTTAGTGCGGGCTTTGCTGCTCCCTGGCCCAGGAAAGAGGGA CTCCCTGACCCTCACCTGGCACCCCCCTGCTGCTGCCCAAGCCGCTGGGCCTTTTTAATT GCCAAACTGCTCTCTTCATCAGCTCAGCACATGCTTTAAGAAA | SEQ ID NO: 2546 |
| TUBB3 | ADXCRAD_CX870071_at | GAAGGTGGCCGTGTGTGACATCCCGCCCCGCGGCCTCAAGATGTCCTCCACCTTCATCGG GAACAGCA | SEQ ID NO: 2550 |
| TUBB3 | ADXCRAD_CX870071_x_at | GTGGATCCCCAACAACGTGAAGGTGGCCGTGTGTGACATCCCGCCCCGCGGCCTCAAGAT GTCCTCCACCTTCATCGGGAACAGCACGGCCATCCAGGAGCTGTTCAAGCGCATCTCCGA GCAGTTCACGGCCATGTTCCGGCGCAAGGCCTTCCTGCACTGGTACACGGGCGAGGGCAT GGACGAGATGGAGTTCACCGAGGCCGAGAGCAACATGAACGACCTGGTGTCCGAGTACCA GCAGTACCAGGACGCCACGGCCGAGGAAGAGGGCGAGATGTACGAAGACGA | SEQ ID NO: 2551 |
| CREB3L1 | ADXCRAD_BU528167_at | GATTCAACTGCCCACGGATTCAAGCCAAACCCTCTGGAAGCGGAACCCAGTTCCTCCAAG TGACACCCGGAGGAACTGGTGCCAGATGCCTCCGACGCCCCCCCATGACCATGGGCAGG GACAGCGAACGGGTTCCCAGAAGTCCCCCGCTTTCTTTGCCCCCCCTACGGGCCCTGTTC AAGGGCCATGG | SEQ ID NO: 2552 |
| PDLIM7 | ADXCRAD_CN278331_at | TCTGCCCACGTGCTCAACGTGCAGTCGTAGCCCGGCCCTCTCCAGCCGGCTGCCCTCTCT GCCTCCCTCTTTCTGTTCCTCCTGCCCAGGGCACCCCCTTAGTGCCTCCAGCTTCTGCCT ACCTCACCCCCCCTTTCGTGCCCCTGGCCTGAGCCTCCTGCTGGCCTGGCCCTGGCCGCC CACCTGGGTTCATCTGACACTGCCTTCCCTCTTTGCCCTGTGGTACTGCTGTCTGCCAGG TCTGTGCTGCCTTGGGCATGGAATAAACATTCTCA | SEQ ID NO: 2560 |
| PDLIM7 | ADXCRAD_CN278331_x_at | TCTGCCCACGTGCTCAACGTGCAGTCGTAGCCCGGCCCTCTCCAGCCGGCTGCCCTCTCT GCCTCCCTCTTTCTGTTCCTCCTGCCCAGGGCACCCCCTTAGTGCCTCCAGCTTCTGCCT ACCTCACCCCCCCTTTCGTGCCCCTGGCCTGAGCCTCCTGCTGGCCTGGCCCTGGCCGCC CACCTGGGTTCATCTGACACTGCCTTCCCTCTTTGCCCTGTGGTACTGCTGTCTGCCAGG TCTGTGCTGCCTTGGGCATGGAATAAACATTCT | SEQ ID NO: 2561 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| PDLIM7 | ADXCRAD_CD366841_at | GATGCGGAAGGAACGCGACTGGCCTGTCCCCGGCCGCGGCCGCCAGTCCTCTGTGTTCTC CATCAGCCGCTGCTTGCTGGCATCTGGGACCAGCGGTCGGAGCGGCTGTCCATTCTGCTG CGGGGCGCTGT | SEQ ID NO: 2562 |
| PDLIM7 | ADXCRAD_CD366841_s_at | CTGTGTTCTCCATCAGCCGCTGCTTGCTGGCATCTGGGACCAGCGGTCGGAGCGGCTGTC CATTCTGCTGCGGGGCGCTGTCAGCGGGCGGGGGCGCCCCANAGGGCCGGGCCGTCTTGT TGAGGGAGACGCTGGGTGCACAGGTGTACCGCGGAGGGTCCGCGGCGGNGGCGGAGGCCT TCTGCGGTTTGCTCTGAACCGGCTGGGCCCTGCTGAG | SEQ ID NO: 2563 |
| PDLIM7 | ADXCRAD_CD366841_x_at | GGAAGGAACGCGACTGGCCTGTCCCCGGCCGCGGCCGCCAGTCCTCTGTGTTCTCCATCA GCCGCTGCTTGCTGGCATCTGGGACCAGCGGTCGGAGCGGCTGTCCATTCTGCTGCGGGG CGCTGTCAGCGGGCGGGGGCGCCCCANAGGGCCGGGCCGTCTTGTTGAGGGAGACGCTGG GTGCACAGGTGTACCGCGGAGGGTCCGCGGCGGNGGCGGAGGCCTTCTGCGGTTTGCTCT GAACCGGCTGGGCCCT | SEQ ID NO: 2564 |
| LMNA | ADXCRAD_AV703605_at | TCTACCGCGGGTTTATACTGGATGAAAAACTCATGCCAACACCAAAAAGCAAACTCCAGG GGGTTCCCCGTACCCAATAGGGCCCATGGTGAGTCGGCCCACAATTAACTTGCCCTTCTA TTACAACCGTCTAGTCTTGCGAAAACCCCTGCGGTTACCCACCCTAAATGGCCTTGCAGA ACTTCCCCCTTTTGCCCGATTGCCGTAACATCCAAACAGGCCCCTACCGATCTGCCCTTC CAACAAATGGGCAACCCTTAATGGGCGAAT | SEQ ID NO: 2565 |
| CDC42BPA | ADXCRAD_BU508210_at | GAAATTTTGAATAACCTATATACACAAATAAAAACACGGGCAGGCCGCCTCTTAGAAGAA TTCCCTCCAAGGGGGCCCAAACTTTACGCGGTACCCCACCTTTTCTTTGGTAAAAAGAGG GGCCCCCTATTAGAGGAGCCGGCATTTTTAACGTTAAGGGACTGGGGCCGGACTATTTTA TAAAGTCTGTGGTAACTGGGAAAAAACTGCCCAACCTTGGGAAACCTTTCGTGAAAGGAA AACTTTTACTTTTGGGGGGTGAGCGCAATAATATGTGGCCACACACTTCCTTCC | SEQ ID NO: 2567 |
| MAP1B | ADXCRAD_BG164365_at | TTGGGCCCCATTTCAGAAAATCTCAGACTCTAAACCACCAGTGATTGCCCTAGCATGCTC CAGAATTGTCCCGCACTTAGTCACTCTGGTTCGATTACTGTTGCGAAACCAGTCCCCCAT TATGACAATACCCAGCGGGGTCTTTGGTAACATGGCCGAGATGAATCAAAACGGGCCCTT CGGGCACGTTAAACCTGCTACTAAACAGGATGGGTAAAACACTCCAGGCAAACACCAGCG AAAGATT | SEQ ID NO: 2568 |
| IL8 | ADXCRAD_BG340548_at | ACTCTGGACATCAGCAGCACGCGGGGCTTCCCATTCAGTCCTGAGAGGGGGGAAGTACG GCAGCCACCTCTCACAGGTGGCTGGTGCTTCCAAGGAGGTCATGCCGGGCACACGCCAAC CCGTGGTGTGCGCAGTCACGCCCCGAGGACAAGAAAAAACGGCCTTCCACTGTTGGCTGA GCTGC | SEQ ID NO: 2570 |
| S100A10 | ADXCRAD_BG675291_at | TGACTTTCAATTCCTGGCCGTTGGTCTGTTGTTCTCAAGAATTCCAAAAGACCCTCTTTG GTGGTGGGACCAACACATATGTAAGGCACCGTGCAACCAGGTTTAATCGAAGTGACCAAG TGAGGGCATCACGAAAGCTTCTTCACCCCCATAATGGGAGGGCAGCACACAATAGCTGT CAGACACCTATTGGTGACGTCACCCTGCTACGGACGGGCAAAAAATTCGCACACAATCGA AGAACCCACCTCCTGATAGAAGTTTCCCAGACGCTCGTTAGAATCGTGCCCA | SEQ ID NO: 2579 |
| RAB31 | ADXCRAD_AL552789_s_at | GACCGACTGGGTATCTAGCTTACTGTTTTAACATCATTGTTGAAACCAGACCCTGTAGTC CAGTGGTGCTGCCCTGTTGTGCAAACTGCTCCTTTTTCTCGTGTTTTTGTAAAGAGCTTC CATCTGGGCTGGACCCAGTTCTTGCACATACAAGACACCGCTGCAGTCAGCTAGGACCTT TCCGCCATGTATTCTATTCTGTAGTAAAGCATTTCCATCAACAATGCCTAATTGTATCTG TTATTTTTGGTTTAACACACACTGATTCATACT | SEQ ID NO: 2580 |
| GALNT2 | ADXCRAD_CO405530_at | GCAACTGAGTGACTCTCACCTACCACCGACTGGGGAGTGGTAAAAGCACTTGACGGATGC CTGGCAACTTAAGACCTGCTGGAAGAGGGGCACAATGCCCCCGGAGCGAGAAAACCCTGA ATCTCATTTCATCCCTTCAATCCGTATGTTTCACAACCCCAACTTTCACTGGCAGTTACT TAAAGTCCTCTCCTGCTCTCTTCCAAGTGTTCTAGGCAAACCCTC | SEQ ID NO: 2581 |
| MVP | ADXCRAD_BP354622_s_at | CTTGTGAGCCCTGGGCTTAGGAGTCACCATGGCAACTGAAGAGTTCATCATCCGCATCCC CCCATACCACTATATCCATGTGCTGGACCAGAACAGCAACGTGTCCCGTGTGGGAGGTCG GGCCAAAGACCTACATCCGGCAGGACA | SEQ ID NO: 2583 |
| PTPLA | ADXCRAD_CD299090_at | ATCTCTGCAAAACAAGTGCTTTTTCCAGAATAACCAAGATTTACTGAGTCCAAGTTTTA ATAACAAGAAATAAACAACCTTTGTGAAAATAATCATGGGATTGGTATGGGTTTT | SEQ ID NO: 2585 |
| PTPLA | ADXCRAD_CD299090_s_at | ATTATTTTCTTCTTATAACCATGGCATCATATATACCTTTGTTTCCACAACTCTATTTTC ATATGTTACGTCAAAGAAGAAAG | SEQ ID NO: 2586 |
| LRP12 | ADXCRAD_BP368157_s_at | GATTGTTTTCATCCTGATACTGTAGTTCACTGTAGAAATGTGGCTGCTGAAACTCATTTG ATTGTCATTTTTATCTATCTATGTTAAATGGTTTGTTTTTACAAAATAATACCTTATTT TAATTGAAACGTTTATGCTTTTGCCAACACATCTTGTAACTTAATAT | SEQ ID NO: 2589 |
| MAPK1 | ADXCRAD_AA467802_s_at | CTCTCTCTGCAGGAGTGCTAATCACTGTGGCTTCTGTTAAGAATTCCCAACTTGATCTCT CTCCTGATGCTGCTGGAAGGATGGAACCGTCATCTCCTCCATCTGAATCACTGACAGGCA TTCTTAGATTTTTAAATCAGGATGCTGAAAACTATCTTTGTCCCTTACCTCCACCTTCTT | SEQ ID NO: 2590 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | TTTGTACCTCCCAGACCCAGGCCCACCTCTCACGTTTATAAGGTCTAGGTCAAGAATACA AATGGAGCCCTACATACCATTA | |
| CD55 | ADXCRAD_AA632649_at | CATCAGAAAGATTCCCAGGCTGGCTACTTCGGGATGACCCTTGCATTTTTTATTGAAATC ATTTCTGAATCTTTTTTCCCCACTAGCTTTTAAGACATAGGAACTATATCTTGTTCAGCT TTGCACTTCCAATTATAAAAAAATGCCTGGCGTGTGTTAGGCACTCAGAAAATGTTTGAA CTGAACCAATGGTGTGTGTGTCTCTGCACACTCTAAGTTAGTGTAAATCAGAACAGCTTG TTGTTGCTGCTTGTTTTGATCAAG | SEQ ID NO: 2593 |
| COL5A2 | ADXCRAD_CN415190_s_at | TACAACAGTTTAGGTTTAAGATGACCAATGACAATGACCACCTTTGCAGAAAGTAAACTG ATTGAATAAATAAATCTCCGTTTTCTTCAATTTATTTCAGTGTAATGAAAAAGTTGCTTA GTATTTATGAGGAAATTCTTCTTCCTGGCAGGTAGCTTAAAGAGTGGGGTATATAGAGCC ACAACACATGTTTATTTTGCTTGGCTGCAGTTGAAAAAATAGAAATTAGTGCCCTTTTTG TGACCTCTCATTCCAAGATTGTC | SEQ ID NO: 2594 |
| NFIB | ADXCRAD_AW975114_at | CTGAGGGTTGGCATGAATGCTTTTCTTTTTCACGTGTAACATTAGGTTCAGACATATATG TGTGCAGTGCATTGCTGTAATGTGTGCACATGGTAAGAACACATATGTCTCAATACCATG CTGTATCGCTCAATAGCCTGACAGATGTATATGGGTGAATTCATTCATTGCCCTCTCTGG TGATTAGTAGCACTTTGAAAATGATGTCGTAATTTGGCAAACT | SEQ ID NO: 2598 |
| KCMF1 | ADXCRAD_CN402369_at | AAGACTGTTGACCACTTGAATTTCTTTGGTGTTAGTGGATTAACCTAACCATTACTCTGA GA | SEQ ID NO: 2601 |
| KCMF1 | ADXCRAD_CN402369_x_at | GGTCTTTCAAACACATCTGCACATAAGTCACACATTTCAATAAAGCATTTTCAAGACTGT TGACCACTTGAATTTCTTTGGTGTTAGTGGATTAACCTAACCATTACTCTGAGATTTTAT ATCTCTAATCCAGTATTTTTTTCTTTTTATGCTAAACATGGGAGATCCTGGTTTTGTGT GAATGCATTATTTTGGATGTGAGAAATAAATGCCAATTATATGTACTTTCCCTTTTCTGC ACAA | SEQ ID NO: 2602 |
| ADAMTS1 | ADXCRAD_CN354195_at | CTGCCAGTTGCAAATTTGATAGGATAGTTAGTGAGGATTATTAACCTCTGAGCAGTGATA TAGCATAATAAAGCCCCGGGCATTATTATTATTATTTCTTTTGTTACATCTATTACAAGT TTAGAAAAAACAAAGCAATTGTCAAAAAAGTTAGAACTATTACAACCCCTGTTTCCTGG TACTTATCAAATACTTAGTATCATGGGGGGTTGGGAAATGAAAAGTAGGAGAAAAGTGAG ATTTTACTAAGACCTGGTTTA | SEQ ID NO: 2604 |
| ADAMTS1 | ADXCRAD_CN354195_x_at | CTGCCAGTTGCAAATTTGATAGGATAGTTAGTGAGGATTATTAACCTCTGAGCAGTGATA TAGCATAATAAAGCCCCGGGCATTATTATTATTATTTCTTTTGTTACATCTATTACAAGT TTAGAAAAAACAAAGCAATTGTCAAAAAAGTTAGAACTATTACAACCCCTGTTTCCTGG TACTTATCAAATACTTAGTATCATGGGGGGTTGGGAAATGAAAAGTAGGAGAAAAGTGAG ATTTTACTAAGACCTGGTTTA | SEQ ID NO: 2605 |
| PEA15 | ADXCRAD_CN347927_at | TGAACTGTCCTTCCATTTGGGATATGTTACATTAGAGTGAGAGAGAGAATAAGGAGCCTT TCTTATGGAAGAAATGGGAGAAGAGAGACAGGGTTCTTTTCAGCAGAGTCTAGTAGTTTC TCTGTAAGGCAAAATAATCTAAAAAGACTAACCTGCCCACCCACTCCTTATATTGCTGTG AGATTGCCCCTATCTTGTGCTCTTCTGTCTGCAGTGTGCACGGCCTTGTTCTAACCC | SEQ ID NO: 2608 |
| RRBP1 | ADXCRAD_CN262594_s_at | CACAGTGAAGCATCTCGAAGAGATTGTAGAGAAGCTAAAAGGAGAACTTGAAAGTTCGGA CCAGGTGAGGGAGCACACGTTGCATTTGGAGGCAGAGCTGGAAAAGCACATGGCGGCCGC | SEQ ID NO: 2610 |
| MARCKS | ADXCRAD_CD103045_at | TGAGGGAGGTTTACAGCACTACAGGTCTTGAGTTAAGAAGGAAAGAGGAAAAAGAAAAAA CCCCCATACCCCGATTTAAAAAAAAAAAAAACCGATCCTTAGTCTTTAGAAGTTCCATTT AAACCCATAGGGAACCTTTTCCCCTTAATCCTCATGGTTAAGCCTGTACCCAGTTCCAG | SEQ ID NO: 2612 |
| OPTN | ADXCRAD_BQ719953_at | TTTGGCTTCATTTAAGCTGTATACTTAGTCATATATCTTTCATTAGTTCTATGGATATGA GCAGATCCCTTTACTGGAGCCCAGTATGTGCTGTGTGAGTTAGAAGTCATTCTTGCTGAG AAGGTGAATAGGTAGGGATTTGCCTTGTTTTGTAAGTCTACAATTTGCCAAGAGTAAATA ACACTGGACCAGCTGT | SEQ ID NO: 2614 |
| LPP | ADXCRAD_CX867590_at | TCTTGATGGGCCTTTTGTCCCAGGACTTCCACATTT | SEQ ID NO: 2618 |
| YES1 | ADXCRAD_BQ439982_at | TTCTCATTGAATGCACCTATTAATCGTTTTAGTTGCTATTCATATTCTCATTCGTTTTTT AAAAATGATATATTCCTGATTTATTCTTCCATTGAGAAAAAATGTTCAGTTACTTGTAAC TACTGAGCAGAATTAATCAATCCCTTTATAA | SEQ ID NO: 2619 |
| PHACTR2 | ADXCRAD_CA390198_s_at | ATCCTTTAGTGCCTCAGAAGATGAAGGCCACAGGGAATACCAAGCCAATGACTCTGACTC GGACGGGCCTATCTTGTACACCGATGATGAGGACGAAGACGAAGATGAGGATGGCAGTGG AGAAAGTGCTTTGGCAAGTAAAATACGCCGGAGGGATACTCTTGCTATCAAACTTGGCAA CAGACCATCTAAGAAGAACTAGAGGACAAAAACATCTTGCAGCGTACATCTGAAGAAGA GAGGCAGGAAATCCGACAACAAATTGGA | SEQ ID NO: 2622 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| MARCKS | ADXCRAD_BM557039_at | AAAATAGCTTTTGAGGATTAACGCAAAAATAAAATAACTCCTTGTACCAGGTCCAGAAAT TGGCCTATTAAAACCTGAATTTGGGCAGTATTTTATAATGGGCCATTTGGCTTGTGGGTT ACAAAA | SEQ ID NO: 2623 |
| ATP2B4 | ADXCRAD_BQ223439_s_at | CCCCATTCAGGTCATGGTAGAATCTACTCCTTGGTAGTCACTTGTCATTTTTANAGAAAT GATGACAATCCTCTTGGCATCACCCCACCCCACATTCTCCCCGATGGTCCTCTCCTGAAT TCTGGATTTTGTCCTACAAGTCTGTGCCATTTATAA | SEQ ID NO: 2627 |
| RRAS2 | ADXCRAD_CX783318_s_at | AACGGCCAGGAAAAGCCCTCATCTTCTCTTTCTCTCCTCAGTTTACATCTTGTTGGTACC TTTCTAGCCTTAGACAAATGATCACCATGTTAGCCTTAGACCAAGAAGCTGGCTAGTCCT TTCTGTGAAGCTAATACAATGGTCATTTCCAGACAAATTTAAAGGAAACACTAAGGCTGC TTCAAAGATTATCTGATTCCTTTAAAATATATGTCTATATACACAGACATGCTCTTTTTT TAAGTGCTTACATTTTAATAGAGATGAATCAGTTTTGGAATCTAAGCTGTTTGCC | SEQ ID NO: 2639 |
| CCND1 | ADXCRAD_BQ436873_at | AAAAATAGTATTTGCATAACCCTGAACGGTGGGGAAGAGGGGTGTGCTACANATGATAG AGGGATTTTATACCCCAATTATCAACTCCGTTTTTATATTAATG | SEQ ID NO: 2640 |
| PTRF | ADXCRAD_BI869786_at | GGTGTATCCCGGTATTTGGTGTACAAACAGTTGGTCCCATTATTGAAGTCGCACTTTTAT ATACACACATAGTACGATGTCAACCGTTGTTTTACACACCGCTGGAGATCGGGCAAAACA CGCGAACAGACACGGGGCGAAACCTCGGGCAGAAGCGCACCCCAACATCACAGAGGGGC TGAACACCAAGGCGCAAAACTCAACCATAAAGCGAGATTAAAGACAGACGAGGGCACAAA GTAAAACCTGTACACGCGCCAACACGGGACACAA | SEQ ID NO: 2642 |
| WNT5A | ADXCRAD_BU627790_at | AGTGGGCTGAATATTCCTTAGGGACTCAATTAATAAGTACTGTCATTTCTAATAGGCATG GGTTTCCATTCTGCAGAATGAACTAAGAAAAGAGAAACATTGCTGATGCTTCTGAGTTTT GAATATCTC | SEQ ID NO: 2645 |
| WNT5A | ADXCRAD_BU627790_x_at | GATATGAAAGCCAACCTGCCTAAGGGGGGTATGAAAGATGTGTATCTTTCCAAACTTTTA AAACAACGTAAGTCTGAGATAAGAACATATTTGATGGCACTGTTTGGAAAGAGGTGTCCT TATTAAAAAAAAAAAAAAAAAAAAGCTATCTATGTAGTGGGCTGAATATTCCTTAGGGA CTCAATTAATAAGTACTGTCATTTCTAATAGGCATGGGTTTCCATTCTGCAGAATGAACT AAGAAAAGAGAAACATTGCTGATGCTTCTGAGTTTTGAATAT | SEQ ID NO: 2646 |
| KIF2C | ADXCRAD_CV804054_at | GCAGCCTGAAAAGCAGGCTAGCAGACAAATAAAGCAAGAAAACGGCCCCATTGACGAC TGGCAATAAAAAT | SEQ ID NO: 2651 |
| KIF2C | ADXCRAD_CV804054_s_at | CTGGAGACCTTTGTGAACAAAGCGGAATCTGCTCTGGCCCAGCAAGCCAAGCATTTCTCA GCCCTGCGAGATGTCATCAAGGC | SEQ ID NO: 2652 |
| COL4A2 | ADXCRAD_BM546367_at | CCTGGAAGGCCACAAGCTTAACCACTTTCGCACAAACCCCATGTTAACCACTGGCNACTT TTCCAATGGCCACAGAACCAACTCACCATTGGTTCA | SEQ ID NO: 2656 |
| COL4A2 | ADXCRAD_BM546367_x_at | TGGAAGGCCACAAGCTTAACCACTTTCGCACAAACCCCATGTTAACCACTGGCNACTTTT CCAATGGCCACAGAACCAACTCACCATTGGTTCA | SEQ ID NO: 2657 |
| IL6ST | ADXCRAD_BQ887381_at | AGGGATTTTTACCACATGAAAGTCATTCCAGTGGACCCTAACCTCCTTATTGGTGGAAGG TTAGTG | SEQ ID NO: 2658 |
| IL6ST | ADXCRAD_BQ887381_s_at | TTTTACTATGGATCAGTCGGCACTCGGGAACAGCAGCAAGGAAAAAAAGCAAATTTCATT CACATGTTC | SEQ ID NO: 2659 |
| IL6ST | ADXCRAD_BQ887381_x_at | TTTTACTATGGATCAGTCGGCACTCGGGAACAGCAGCAAGGAAAAAAAGCAAATTTCATT CACATGTTCTGGGTTCATACCTCTTCTCTACCTAATTGGTCATTTTAAATTTCCAGCCTT ATTCCCTGGATAAGGGATTTTTACCACATGAAAGTCATTCCAGTGGACCCTAACCTCCTT ATTGGTGGAAGGTTAGTG | SEQ ID NO: 2660 |
| RRAS2 | ADXCRAD_BU929840_at | GTATTCCCTGCTAGATATTGATTGTTATTTCAAGTATTAAGTGTAAGCTTTTAATGGATA ATTAGTATAACTGTGGATGGCATCTGATTTTGTTTTTAATTCTGTGGATTGTGTTTAAGC AATTCAATAGTATGTTCCTGATTTTGAGATGCTAAGTGGTATTGCACAGTTGTCACTTTA TCAAGTGTGTACAACAGTCCCATGAAGTTTATAGAGCATACCCTTGTATAGCTTCAGGTG CTAGA | SEQ ID NO: 2662 |
| PRNP | ADXCRAD_CX762421_at | ATAACATTGGTTATCTGGACTATTTTGGACTAGTGCACAGGTGAGCTAAACAATCTAGAC ATCTGAATACTTGCTGGATCTCTGCTCTCACACTAAGTCATACTATGCTACTATAAATCA ACTATAAGAATCATTAGAACGAACTCGCAG | SEQ ID NO: 2673 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| PRNP | ADXCRAD_CX762421_s_at | CTCTTTGTCCCGGATAGGCTAATCAATACCCTTGGCACTGATGGGCACTGGAAAACATAG AGTAGACCTGAGATGCTGGTCAAGCCCCCTTTGATTGAGTTCATCATGAGCCGTTGCTAA TGCCAGGCCAGTAAAAGTATAACA | SEQ ID NO: 2674 |
| SPTBN1 | ADXCRAD_AW028717_at | CTTGCCTTAAAGCAGCATACTTATTTTTTGTTTATTTATTGTGAGCTTTNTACTTTATTA AGATTNTACAGCGAAACCCTTACATGAGTAATTGAAATG | SEQ ID NO: 2675 |
| SPTBN1 | ADXCRAD_AW028717_s_at | TGAAGTTCACTACCATTTGTCAAGAATCACCCTTTCCAAATCCTCTGGGTTTTGACTTTT TGGCTTCCACTTCACCCAAAATGTTAAAATTTTTACTTAATTCATAGCCTTCCTTGGTTT CATATTTGTTTGCATTTAATTCATGTTTGAGTCTCTTAACTGATGGATGCCCACTTGCCT TAAAGCAG | SEQ ID NO: 2676 |
| SYNJ2 | ADXCRAD_BF875753_at | TCATAGGGAGAAGAGCGCTGCTTGTGGCAGGGTGGCGTGTGGCTGTCATTAAAGTGCGTT CCTTTAATGAGCGCTCAGGGCTCCCAGGGGCCTGCTGCTATGCCATGGGGTGGGGCTGCC AGCAGGGCAGGGGGTTGATCCCATCACATCTCCCCAGACACATCCTCAGGAAACCACCTC AAAACCACCTAAGAACAAAGGAAGTTATCACACTGGGGACAGGGACACGGGTCAGAGTTC AGCTACGCTGGAATGGAA | SEQ ID NO: 2677 |
| SYNJ2 | ADXCRAD_BF875753_x_at | TTTCCTCACCACACTTCATAGGGAGAAGAGCGCTGCTTGTGGCAGGGTGGCGTGTGGCTG TCATTAAAGTGCGTTCCTTTAATGAGCGCTCAGGGCTCCCAGGGGCCTGCTGCTATGCCA TGGGGTGGGGCTGCCAGCAGGGCAGGGGGTTGATCCCATCACATCTCCCCAGACACATCC TCAGGAAACCACCTCAAAACCACCTAAGAACAAAGGAAGTTATCACACTGGGGACAGGGA CACGGGTCAGAGTTCAGCTACGCTGGAATGGAA | SEQ ID NO: 2678 |
| MAP7D1 | ADXCRAD_BU178034_x_at | GTAAATAGCTTGTGCTCAGACTCCTCTGCGTGGAGAAGGTGGGTGCANGAGGCAGACCCT CCCCCCAAAGCCCCCTGGGGAGATCTTCCTCTCTCTATTTAACTGTAACTGAGGGGGGAT CCCCAGGTCTGGGGATGGGGGACAACCTTGGGGCCACAGGATACTGGGTTTGCTTCAGG GGGTACCCATGGCCCCCCTGCCCTCGGCCTGGGAATCAGTGGNTACTGGCATCTGAATTA AAATGTTCTTCCCCGA | SEQ ID NO: 2681 |
| LRP12 | ADXCRAD_BP262656_s_at | AAACGAAACGAGTGATGATGAGGCTTTGTTACTTTGTTAGGTACGAATCACATAAGGGAG ATTGTATACAAGTTGGAGCAATATCCATTTATT | SEQ ID NO: 2687 |
| PHACTR2 | ADXCRAD_AV721683_at | TATTAGAAAAGTTGAATCGCATGACTACATTTATACAGGGGAAATTCAAGCATTTGTGTG TGAATTAAATGCTTCGTTAATAGGATAAGCAGGTGATTCATTTGGAACTTATGGGATGCA GCATAACCAGGTGAAATCTAATGGTGATTTATTTCCAAAGACCACCAGGTTTGTTCAAGT GCATTGCTAGTCTGTGTTTGTGTTTAACCCATGCAACAATCCTCATGACAGTAACAAGGA TTATGACCAAT | SEQ ID NO: 2690 |
| CORO1C | ADXCRAD_BU181829_at | GGTATTTGCCCTGGGGGATCCTGATACCCTGGGCTG | SEQ ID NO: 2692 |
| PHACTR2 | ADXCRAD_CN369598_at | AAAAGGTCCAGTTTTACAGCCTGCAATTAATTCAGGGCTGCGTTGGCATTAAAAAAGAAA ATATATATATATATATATATATATATATATATATATGTATATTATATATACAGTAGCT TACACTTAAAAGAGGAAAAATTTGCATTAACATTGCATATTCTGATATGTACCATATTAA CACATAACAGGCATTTTATTTATGCTTCATAGAATCAGACAGACACAACTTTCAAAA | SEQ ID NO: 2693 |
| JUN | ADXCRAD_NM_002228_s_at | CAGCCCACTGAGAAGTCAAACATTTCAAAGTTTGGATTGTATCAAGTGGCATGTGCTGTG ACCATTTATAATGTTAGTAGAAATTTTACAATAGGTGCTTATTCTCAAAGCAGGAATTGG TGGCAGATTTTACAAAAGATGTATCCTTCCAATTTGGAATCTTCTCTTTGACAATTCCTA GATAAAAAGATGGCCTTTGCTTATGAATATTTATAACAGCATTCTTGTCACAATAAATGT | SEQ ID NO: 2694 |
| LOXL2 | ADXCRAD_BI825165_at | GGAATAACAAGAAAGATCTATGAACAGAACACAAACAAACACAGCAAGCTAACAAAA | SEQ ID NO: 2695 |
| CASK | ADXCRAD_CX786970_at | TGGTCCCTAGAGACTACCTAGTTGTAGTGTGACCTACATTTATAATTATTGTCATGTCCG AATAGATAGGAGGAGAAAAACAATTACACACTAATTTAAAGAGACAGTATCTTTTTTAAT CAGTTCTCCTAAACTTTAATAAAATGTATCTTTAAATGTATGTATTATTCAATCCTTTGG AATGTTATATTTTTGGAAATCATAGCTTTTTA | SEQ ID NO: 2696 |
| MGAT1 | ADXCRAD_BP302925_at | AAAATCAGTGCCCTCCCTGTTGCTCTAGGAGGCTCCTGCTGGCTTGGTAGAAGACAGAAT TCGATCTGCCTGTCCCTTTTTCCCCTGGGGTTTGACACACAGGCTCCTCTCAGCATGAGG TGGAGCAGTGACCAGGTGGAGCAGTGACCAGGACGCCTCTGGCCCAGTGCTGCCCAGCCT CCCCGCCCGCTCCCAGGCGCCCCATGTCCTCACAGGCCAGGACGCCATGGCAGGATGGAG AGGACTTGGTGGATTTTT | SEQ ID NO: 2697 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| MGAT1 | ADXCRAD_BP302925_x_at | AAAATCAGTGCCCTCCCTGTTGCTCTAGGAGGCTCCTGCTGGCTTGGTAGAAGACAGAATTCGATCTGCCTGTCCCTTTTTCCCTGGGGTTTGACACACAGGCTCCTCTCAGCATGAGGTGGAGCAGTGACCAGGTGGAGCAGTGACCAGGACGCCTCTGGCCCAGTGCTGCCCAGCCTCCCCGCCCGCTCCCAGGCGCCCCATGTCCTCACAGGCCAGGACGCCATGGCAGGATGGAGAGGACTTGGTGGATTTTTGTTTCTTGCCTGACCTCAGTTTCATGAAAGAA | SEQ ID NO: 2698 |
| AMOTL2 | ADXCRAD_BU580920_at | GTGTCTGTATGTTTAAGTTATCGTAAATATTTAAAATGTAAACATGGCTGTTTTGTTATGCCACCCTGTACCAGGATTG | SEQ ID NO: 2699 |
| AMOTL2 | ADXCRAD_BU580920_x_at | TTAAAGTATTTTTTGTGCTGTGAACATTTTCTGCCAAAGACCATGATGTGTGTCTGTATGTTTAAGTTATCGTAAATATTTAAAATGTAAACATGGCTGTTTTGTTATGCCACCCTGTACCAGGATTGCTG | SEQ ID NO: 2700 |
| HK1 | ADXCRAD_BG675101_at | AAAAATAGAGGCTCACCCCAGTCTCGTCGGCAACAGGGGGGCCCCCAAAGAGGAGGGCATATATAGACGCCACGCGAGCGGCGGCTATAAACCACACGCTGCAGGGGGAAACACGCCGCACCTAGCGCCCTGGGGAAGACGCCCATACATGAGGGCGGGGCCACACGTGGGACACACACTCACCGAAAATTAGCGCCGGGGGAACAACAATGCGGGGTAGCGGGCAACACAGCGGAGGGCGCGGGAAGAAATGCCACGGGCATATGAGCCATAACCG | SEQ ID NO: 2702 |
| PYGL | ADXCRAD_BQ933107_at | TTGGTTTTGTAAGCTAACAAATCTATAATAATTTGAGTATCCCCGGGGAATG | SEQ ID NO: 2703 |
| PDLIM7 | ADXCRAD_CN298673_at | ATCAACCTGGAAGGAAAGACCTTCTACTCCAAGAAGGACAGGCCTCTCTGCAAGAGCCATGCCTTCTCTCATGTGTGAGCCCCTTCTGCCCACAGCTGCCGCGGTGGCCCCTAGCCTGAGGGGCCTGGAGTCGTGGCCCTGCATTTCTGGGTAGGGCTGGCAATGGTTGCCTTA | SEQ ID NO: 2706 |
| CDH11 | ADXCRAD_CX866982_s_at | GGGTCCCTGAGCTCCCTAGAGTCGGCCACCACAGATTCAGACTTGGACTATGATTATCTACAGAACTGGGGACCTCGTTTTAAGAAACTAGCAGATTTGTATGGTTCCAAAGACACTTTTGATGACGATTCTTAACAATAACGATACAAATTTGGCCTTAAGAACTGTGTCTGGCGTTCTCAAGAATCTAGAA | SEQ ID NO: 2709 |
| TUBB3 | ADXCRAD_CN295380_at | GGGCCCCAAGTGAAGCTGCTCGCAGCTGGAGTGAGAGGCAGGTGGCGGCCGGGGCCGAAGCCAGCAGTGTCTAAACCCCCGGAGCCATCTTGCTGCCGACACCCTGCTTTCCCCTCGCCCTAGGGCTCCCTTGCCGCCTCCTGCAGTATTTATGGCCTCGTCCTCCCCACCTAGGCCACGTGTGAGCTGCTCCTGTCTCTGTCTTATTGCAGCTCCAGGCCTGACGTTTTACGGTTTTGTTTTTTACTGGTTTGTGTTTATATTTTCGGGGATACTTAATAAATCTATTGCTGTCAGA | SEQ ID NO: 2710 |
| NT5E | ADXCRAD_BG611920_at | TAAAAATTGGACAGATTAGCCCAAAAAAGACACAATCACAACAAACAAAACAAAACTATTGTTGGCGGCACTGTGCGCCCCAAAGAAACTCTGTAAAACACCTAGCGGTTAGGCACAGCGGCCCCATAGGAAAGCGAACATGTGCAAACATGTCCCCAGAAAAACCCGGAACAAAAAACGGCGCGGAAACGCACCCAAAAAACACGCCCGGGGAACCGCGGTTTTGGACAAACCAGAGACATCACAACAAAA | SEQ ID NO: 2714 |
| LIF | ADXCRAD_BU175373_at | GCACATGGGCCTTGGGGTGACAAATTCCCTCCTTTGGATGAATGTACCCCTGGGGGGATGGTTTCATACTGGAAGGATTAATTTTTTATTTCATTCCCATGGGCCATAATTCTAAAAAT | SEQ ID NO: 2715 |
| LIF | ADXCRAD_BU175373_x_at | TTTCCACTGAAAAGCACATGGGCCTTGGGGTGACAAATTCCCTCCTTTGGATGAATGTACCCCTGGGGGGATGGTTTCATACTGGAAGGATTAATTTTTTATTTCATTCCCATGGGCCATAATTCTAAAAAT | SEQ ID NO: 2716 |
| JUN | ADXCRAD_AJ712294_s_at | AGGAAGCGCATGAGGAACCGCATCGCTGCCTCCAAGTGCCGAAAAAGGAAGCTGGAGAGAATCGCCCGGCTGGAGGAAAAAGTGAAAACCTTGAAAGCTCAGAACTCGGAGCTGGCGTCCACGGCCAACATGCTCAGGGAACAGGTGGCACAGCTTAAACAGAAAGTCATGAACCACGTTAACAGTGGGTGCCAACTCATGCTAACGCAGCAGTTGCAAACATTTTGA | SEQ ID NO: 2719 |
| TGFBR2 | ADXCRAD_BI334991_at | TGTACTCATGTTTTACCAACTCCGGAATGTGAATGCTATAATACTCTTTTTATATCACAAAGGTCCTCAAGCACTTTATTTCTATTCTAATGCATTGGTGTGTCCTTTTACCATTAACTCACAACTGTTTCCTCCAGACTGGATTACAGCAAATACTCCTGGGTCAAAACAAA | SEQ ID NO: 2720 |
| LAMB3 | ADXCRAD_CB122452_s_at | TACTATGCCACCTGCAAGTGATGCTACAGCTTCCAGCCCGTTGCCCCACTCATCTGCCGCCTTTGCTTTTGGTTGGGGGCAGATTGGGTTGGAATGCTTTCCATCTCCAGGAGACTTTCATGTAGCCTAAAGTACAGCCTGGACCACCCTGGTGTGTAGCTAGTAAGATTACCCTGAGCTGCAGCTGAGCCTGAGCCAATGGGACAGTTACACTTGACAGACAAAGATGTGGAGATTGGCATGCCATTGAAACTAAGAGCTCTCAAGTCAAGGAA | SEQ ID NO: 2721 |
| YWHAZ | ADXCRAD_CX870884_at | TCTATTATGAGATTCTGAACTCCCCAGAGAAAGCCTGCTCTCTTGCAAAGACAGCTTTTGATGAAGCCATTGCTGAACTTGATACATTAAGTGAAGAGTCATACAAAGACAGCACGCTAATAATGCAATTACTGAGAGACAACTTGACATTGTGGACATCGGATACCCAAGGAGACGAAGCTGAAGCAGGAGAAGGAGGGGAAAATTAACCGGCCTTCCAACTTTTGTCTGCCTCATTCTAAAATTTACACAGTAGACCATTTGTCATCCATGCTGTCCCACAAATAGTTTT | SEQ ID NO: 2722 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| GATA6 | ADXCRAD_BX384651_s_at | AAATTGCCTTTCTCTATTTGTTAAGAATTTTTATACAAGAACACCAATATACCCCTTTA TTTTACTGTGGAATATGTGCTGGAAAAATTGCAACAACACTTTACTACCTAACGGATAGC ATTTGTAAATACTCTAGGTATCTGTAAACACTCTGATGAAGTCTGTATAGTGTGACTAAC CCACAGGCAGGTTGGTTTACATTAATTTTTTTTTTTGAATGGGATGTCCTATGGAAACCT ATTTCACCAGAGTTT | SEQ ID NO: 2725 |
| NFIB | ADXCRAD_BQ672667_at | AGTTCAGGCCTCTGGGATCAACCCCAGACTGGGCCAGAATGTTAGTGAAGGTTTTATTGT GCCCGGTTGGAGGATAACGTTCTTTGGGTACTTTTTGTGGGTTGCAAATGAACTCAATTG CCACAAGTTTTAAACTGGTGTAAATCAAGCTTGACTTAATGTGATTGTTACTGTTATATC CAGCCTATACTGCTAGCAGCTGCTCATACTGCAGTCAATTACTGGAAGCGGATATATTTC CTATGCAAAA | SEQ ID NO: 2727 |
| ZFP36L1 | ADXCRAD_CX782083_at | TCCCGGAGCCTCTGCCCATGGCGGGGTGGAGACCCGGAACCAGCAGCCCCCTCCACTGGC GACACAACTGCACCTTCCCTCATTTCAGTCTCCCGCACACTTATTCCTCCTCCCCTCTTC CCGGTGGCACCTCTCCACCT | SEQ ID NO: 2731 |
| ZFP36L1 | ADXCRAD_CX782083_s_at | TTCTTCCCGATCTGAACCCCTGTTGACTAATCTTGCCTGGGTTTGTGTAGGTCTGCAGGA AGGA | SEQ ID NO: 2732 |
| COL4A1 | ADXCRAD_CX761316_s_at | AGCCGCTGCCAAGTCTGTATGAGAAGAACATAATGAAGCCTGACTCAGCTAATGTCACAA CATGGTGCTACTTCTTCTTTTTTGTTAACAGCAACGAACCCTAGAAATATATCCTGTG TACCTCACTGTCCAATATGAAAACCGTAAAGTGCCTTATAGGAATTTGCGTAACTAACAC ACCCTGCTTCATTGACCTCTACTTGCTGAAGGAGAAAAAGACAGCGATAAGCTTTTCATA GTGGCATACCAAATGGCACTTTTGA | SEQ ID NO: 2733 |
| LDLR | ADXCRAD_BX113541_x_at | AACTCAGCTGGACTTTTCTTGCTTTAATAACAGCTTTATTGAGATACAATTCACATATCA CGAAATTCTTTTTAAAATTTTACAGTTCAGGCCGGGCGCGGTGGCTCATGCCTGTAATC CCAACACTTTGGGAGGCTGAGGCTGGCGGGTCACCTGANGTCAGGAGTTCGAGACCAGCT TGGCCAGCATGGCAAAATCCCGTCTCCACTA | SEQ ID NO: 2735 |
| ACTN1 | ADXCRAD_BM714793_at | AAGAGAATTTATGTGGCTTCTCATTTTTAAATCCCCTCAGAGGTGTGACTAGTCTCTTTA TCAGCACACACTTAAAAAATTTTTAATATTGTCTATTAAAAATAGGACAAACTTGGAGAG TATGGACAACTTTGATATTGCTTGGCACAGATGGTATTAAAAAA | SEQ ID NO: 2737 |
| RYBP | ADXCRAD_BU151619_at | AAGGTTATCAACCACACATCCAGTCCTGACATGGAGCTTTTCAGTGTTTGGAGACATTTC TCAATCCCTGCTGTGGTAGGAACTCCAGTGGTGAACGGCTTGCGCGCCTGCAGCCAGAG TTGCAGGGAAAGCTCGTACTTACTGCGAGCAGCATGTAATCTTTTTCTTCCTGGACATA AAGATAGCTTGAGTAAACTGTTCTATTTCATTCTCTTCACTCTTTTTACTGTCTTGCAAA AA | SEQ ID NO: 2738 |
| TRAM2 | ADXCRAD_BM700086_s_at | AGGCTGTGTCATTGGCAGGGCTTCACATGCAGGAGGCCTCTCTCAGGTGAGTCCAGGTTA AACTGTTGAGTTGTGGCTTCAACAGATATGTATGGCATGCTGGGATGTGCCAGGTGCCTG CGTTGTGCCAGTTGCTGGAGAGGTAGTGTGAGCAGAGCAGCTGAAATCTTGCCATCAAGC AACCCTCATTCTCATGCCTGTAGGTTTCCATTGCTCTGTCCCAGGACACTTGCGTGCCAG AGACGCCACAACTTCATGTCCCTGTCTCTTGCAA | SEQ ID NO: 2739 |
| CDC14B | ADXCRAD_AW021718_at | AGACTTTTATCTAACCTGCACTCATGTACAGATTATTAAAAGTTTTAAAATGTAACTGAT CAGTATTGATCAATCATTGTCTTGATT | SEQ ID NO: 2742 |
| SEC61A1 | ADXCRAD_BQ711397_at | TCCTGGCACTGGCAAAAAGAACTGTGAAAGTGAAATTTTATTCAGCCGACTGCCCAAAAA GTGGGAAATGGGAATAGGATTGTCCCCCAGTGTCCATGGTAACTTTTGTTTTAACCTTTG CACCTTCTCAGTGGCTGTATGGCGGCTGCAACCGGCCTCACCTGTTTTCCCCCCAAAGGG GATTTCTCCACCTCTTGGTTGGAAACACCAA | SEQ ID NO: 2746 |
| CRIM1 | ADXCRAD_C16716_s_at | CTTCTAGCCGTCAAACTCTGATCGACTTACACTTAAGACTGTGTCTTTGGTAGCCTACCC TATTCCACTTTTATTACAAAGGCAGCTCTTAAGACATAAATCCATCTCTTCAGGCTCGAA CTGCAAAACACACGTCGAGAGGTGACAATGTTGGGACTGTCAAAAAGAACTTAAAGAGTG GGATAACCAGCCGGGC | SEQ ID NO: 2751 |
| CASK | ADXCRAD_BP254716_at | TCCTCAGGAGCAGTCTCACAGGTGCTGGACAGCCTGGAAGAGATTCATGCGCTTACAGAC TGCAGTGAAAAGGACCTGGATTTTCTACACAGTGTTTTCCAGGATCAGCATCTTCACACA CTACTAGATCTGTATGACAAAATTAACACAAAGTCTTCACCACAAATCAGGAATCCTCCA AGCGATGCAGTACAGAGAGCCAAAGAGGTATTGGAAGAAATTTCATGTTACCCTGAGAAT | SEQ ID NO: 2753 |
| ADAM9 | ADXCRAD_NM_001005845_at | TTTGTGTCTCCTAGTAGCTTCCTACTCAACTATTTATAATCTCATTAATTAAAAGTTAT AATTTTGATAAAATTCAGTCAAATTTTTACAGATATTATCTCACTAATTTTCAGACT TTTGCCAAAGTGTGCACAATGGCTTTTTGTTAATAAAGAACAGATTAGTTTTGAAGAAGG CA | SEQ ID NO: 2758 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| ADAM9 | ADXCRAD_NM_001005845_x_at | TACTTGAAATTCTCTTTTGTGTCTCCTAGTAGCTTCCTACTCAACTATTTATAATCTCAT TAATTAAAAAGTTATAATTTTAGATAAAAATTCTAGTCAAATTTTTACAGATATTATCTC ACTAATTTTCAGACTTTTGCCAAAGTGTGCACAATGGCTTTTTGTTAATAAAGAACAGAT TAGTTTTGAAGAAGGCAAAAATTTCAGTTTTCTGAAGACAGCATGTTAT | SEQ ID NO: 2759 |
| PHACTR2 | ADXCRAD_NM_014721_at | TAACCACAAGACCTCTCTATAATGGTAAATGTAAGACATCACCATTTTATCACTCAAAGT ATGTTATTGAAAGTTTCTATTTGGTTGATAAAAGGAACAATTTTTTCCCACTTTTGATGC CTGTGATGCAATTTTTTATTGCCTACAATGAGATACACTTAGTACAAAAAATGAAAATCT GGTATTTCAAAATTGCATTTCTTGTATAATAGGTCAGATTTATTAACTACTCATACTTTT TCTTTACACTAATCGATACATTTA | SEQ ID NO: 2761 |
| PHACTR2 | ADXCRAD_NM_014721_x_at | TAACCACAAGACCTCTCTATAATGGTAAATGTAAGACATCACCATTTTATCACTCAAAGT ATGTTATTGAAAGTTTCTATTTGGTTGATAAAAGGAACAATTTTTTCCCACTTTTGATGC CTGTGATGCAATTTTTTATTGCCTACAATGAGATACACTTAGTACAAAAAATGAAAATCT GGTATTTCAAAATTGCATTTCTTGTATAATAGGTCAGATTTATTAACTACTCATACTTTT TCTTTACACTAATCG | SEQ ID NO: 2762 |
| EGFR | ADXCRAD_NM_201283_at | ATCACAGGTTTGAGCTGAATTATCACATGAATATAAATGGGAAATCAGTGTTTTAGAGAG AGAACTTTTCGACATATTTCCTG | SEQ ID NO: 2765 |
| EGFR | ADXCRAD_NM_201283_s_at | AATGCTACGAATATTAAACACTTCAAAAACTGCACCTCCATCAGTGGCGATCTCCACATC CTGCCGGTGGCATTTAGGGGTGACTCCTTCACACATACTCCTCCTCTGGATCCACAGGAA CTGGATATTCTGAAAACCGTAAAGGAAATCACAG | SEQ ID NO: 2766 |
| ULK2 | ADXCRAD_NM_014683_at | AAGTGATTGGCCTAAAGTCAGGAACTAGGCAAGTGGTCAAGCCATGCTTTGTGACTTTCA AGTTAATTCTTCTTGTTCTTGTATATTAAAGGTCTTGGGGTAGATGGTGGTGTGTGAAACA GTGAAGTCTCAACAGCAGAAAAGAACAAAATGTAAATTCATGAATAATGGTTCTGGTTAT ACTTCCATTATCAAGGCTAATTAAGAGATTTTGCCTTGAGTATAGCAATAATAAACAAAT GCTTTATGTTTCCCT | SEQ ID NO: 2771 |
| NT5E | ADXCRAD_BC015940_at | TTCTTTACACAGGTAATTGTTTCAAAAGGATTGCATGGGCCAGGATGTCCAGATAAGCAC TGTGTCTCTTTTGCCTTTGTAACTGTTATTACTCTTTTTACTGCTATTTAATATGTAATG TATATTATATGATCTATAATATATATGTAATATACATTAAATGGGAACATGTGCAAATCT TACAAAA | SEQ ID NO: 2778 |
| LPP | ADXCRAD_AL833171_at | TTGGCCTATTCTGGACTGCAAATAGCATTGCCAAGCACTTCCCTTAAATAACTTCTCTTT TTTGCAGGACTATCCTCTCAGCCCTGCCAAAACCCCATCACCTACTCTTTCTTTACTACT TTGCCTATTTAATGCTGGAATTTTTATTTAAACTGTAGCTGATTTACTGAAGGTAATTAA GTGCTTTCATGCTGTAGATCTCCTGCTAGACTACAGGCTGTACTTGGGAGTGAGAGTGAA CCAAATGTAA | SEQ ID NO: 2784 |
| CRIM1 | ADXCRAD_BC016339_s_at | AAGAATCTTCACTTGGGTGCAGCCTGTTATCTCTGTAATCTACCTGGAGGTGACCCATAT CTAGGAGAAAAAAAATTATAAGCATTATTACCTAAACCAGAATTGTTAAGGATTATTTT AATGACATTGCAAATAGAGATCAGCAACTTGGTTTTATTGCTTCCCAGTTTTTTGAGGCT AAAAATGTGATTAAAATCTAATGTTGATCCAAAGAGCTCTTAGTAGAGAGCAGAGCGCTT A | SEQ ID NO: 2786 |
| ZNF264 | ADXCRAD_AL832061_x_at | AGGCATGATGGCAGGCACCTCTAATCCCAGCTACTCAGGAAGCTGAGGCATGAGAATCGC TTGAACCCAGGAGGTGGAGGTTGCAGTGAGCTGACAGCGTGCCACTCTACTCCAGCCTTG GTGATAGAGTGAGACTCCA | SEQ ID NO: 2787 |
| LDLR | ADXCRAD_BC021296_s_at | GTCCCTGCTGTTTAGATGTCGTGTTGTAGGAGCCTGTTGCTCAGCCTCCCGAGTAGCTGG GATTACAGGTGCCTGCCACCACACCCAGCTAACGTCTCTACTAAAAATACAAAAAATTAG CCGGGCGTGGTGGCGGGCACCTGTAGTCCCAGCTACTCGGGAGGCCGAGGCAGGAGAATG GTGTGAACCCGGGAGGCGGAGCTTGCCGTCAGCCAAGATAGCGCCACTGCATTCCCGCAG CGAAAGAGCGAGAC | SEQ ID NO: 2788 |
| MDFIC | ADXCRAD_BC040713_at | TTCAGCAGATCCAGGACTGCCGCAGCTCTCTGAACAAGCGTGCACTTACTCCATTTCATC TT | SEQ ID NO: 2789 |
| MDFIC | ADXCRAD_BC040713_s_at | CTGTTTCTTGTTGGCTCCTCTACCACCCGGTTGATAATTCAGGTTTCTGTGACCAGTAGC TTTGGAATGGCTTATGCTTGTTTTCA | SEQ ID NO: 2790 |
| MDFIC | ADXCRAD_BC040713_x_at | ACAGCCCAGGGTCTCTTCAGCAGATCCAGGACTGCCGCAGCTCTCTGAACAAGCGTGCAC TTACTCCATTTCATCTTTCTGTTTCTTGTTGGCTCCTCTACCACCCGGTTGATAATTCAG GTTTCTGTGACCAGTAGCTTTGGAATGGCTTATGCTTGTTTTCAAT | SEQ ID NO: 2791 |
| PLAUR | ADXCRAD_AF087989_at | TTAGCTGGGCATCAGGCATCGTGCACAATCCTGTACTCCCGGCTACTTGTGAGGCCGAGG TAGGAGGATTGTTTGAGCCTGGGAGGTCAAGGCTGCAGTAAGCTATGATTGCACCACTGC ATCCTGGTTGACAGAGCAAGATTCTGTAAGTAAGTAAATAAAATAAATAAATAAATAAAT AAATATAGCAAGCTGGTTTGGAGTGAGGAATATTAA | SEQ ID NO: 2792 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| PLAUR | ADXCRAD_AF087989_x_at | TTAGCTGGGCATCAGGCATCGTGCACAATCCTGTACTCCCGGCTACTTGTGAGGCCGAGG TAGGAGGATTGTTTGAGCCTGGGAGGTCAAGGCTGCAGTAAGCTATGATTGCACCACTGC ATCCTGGTTGACAGAGCAAGATTCTGTAAGTAAGTAAATAAAATAAATAAATAAATAAAT AAATATAGCAAGCTGGTTTGGAGTGAGGAATAT | SEQ ID NO: 2793 |
| CAST | ADXCRAD_AK026822_at | TGGCCCACACATCAAAGTCCTCGAGTTTAGGACTGAAGAAAAGTCTGCTTTTGTAGAAAA TGTGTATGCTTCATGTTCTCTTTTACCAGACAATGAGAATAACTCATACTGATTCCTCAT TTTTCCTTGACTTCCAGGAATGTCTGTGATAAATTCAGGGGACAATTGCGAGAATTATCC TCAGCCATAAGTCCCTCACATGGTTATCACCTGTCCATTATGTATCTTTTTGTCCTTCAT TTTAACATTTCTTTTATACATGGATCTTA | SEQ ID NO: 2794 |
| ZNF264 | ADXCRAD_AL833343_x_at | TTGAAGTGAACTGAGATCTCGCCACTGCACTCCAGCCTGGGTAACAGAGCTACTCTGTCT CAACAACAACAACA | SEQ ID NO: 2796 |
| WNT5A | ADXCRAD_NM_003392_s_at | CAGATTGTTCCTTTTTAGTGACTCATGTTTATGAAGAGAGTTGAGTTTAACAATCCTAGC TTTTAAAAGAAACTATTTAATGTAAAATATTCTACATGTCATTCAGATATTATGTATATC TTCTAGCCTTTATTCTGTACTTTTAATGTACATATTTCTGTCTTGCGTGATTTGTATATT TCACTGGTT | SEQ ID NO: 2804 |
| SEPT7 | ADXCRAD_AI831470_at | ATTAAGTTTATCCTTTTCTCCATCTTTTCTTTCTTGCCACCTAATGAAGGAAATGTCTCC AAGGTCTTTTTGACTAATAGAAACTAAATGTATAACTCGACATCTAGAAGGGTTTCAAGA TAGTAGATATGTCTGCTGGGATGTTTTGTCATTACCCTGCCCAATGTTGCGACGCTAGGA GTTTCCTTGACACTACATTATAAATAAGGCCCAACCTGTTAGCAAAAATATCACATTCCC TAATTTTCTCTCCTTTAACTGTGTGTAATTTATCCAGGCATGTCTTTAGTTCAG | SEQ ID NO: 2805 |
| BCL6 | ADXCRAD_AW264036_at | AGGATCGCTGCCTGCGCTGCGCTGGCCGCCGGGGATTCACCCGGGGAGGCGGGGCCGCTG GGGAAGGCTCGCGGGGAATACAGCACACTTTCCCCTAAATCCCTCGTCCGCGCCGAGTGC AGGGCTCTCAGAGTTCACCTAGTCCCACCTCTCACCCACAACAGTTTATAAATGGGGAAG GTCAGACAAGTTAGTAGCAGAGCTGGGTCTAGAACCCAGGAGTTCGAATACAATCCGAGG CTCATATCGAGACTTTAAGTTGTCCGATTCCGAAGTTTATTTGCT | SEQ ID NO: 2806 |
| AURKA | ADXCRAD_NM_003158_at | GTTAAGGCACACCTGCTGAGTAAAACAAATATTTCTTGTGTAGCGTTCTTAGGAATCTGG TGTCTGTCCGGCCCCGGTAGGCCTGTTGGGTTTCTAGTCCTCCTTACCATCATCTCCATA TGAGAGTGTGAAAATAGGAACACGTGCTCTACCTCCATTTAGGGATTTGCTTGGGATACA GAAGAGGCCATGTGTCTCAGAGCTGTTAAGGGCTTATTTTTTTAAAACATTGGAGTCATA GCATGTGTGTAAACTT | SEQ ID NO: 2810 |
| EGFR | ADXCRAD_AA678124_at | AGCTGGACGCCTCTCTGACAATTGTGGCTCTGGTGGTGAACCCCTCGGTGTCTCTTCTGC ACCTCTCAAGGCTGCAAAGTGCCAAATACTCTTTTCCAACCAGCTCCCGAATTCCCCCCT CCATCTGGGACTGCATGTCCTGCTTAGCGATTTCAAGCAATGATTTCACCTTTTCATGA CAAGGACATTGTCTCATCAGGGCTTGACCATCACTCTGATTTCCAATGCTGACAGCCAAG TGGAGGTTT | SEQ ID NO: 2813 |
| NR3C1 | ADXCRAD_AI934556_at | GATGAATGTGCGCTTTGGAAATGTTTAAATAGATATGAAATGATTAAATAAAATCACAGT CTTGTGCAACATCCATAGCTTACAGTTATTTGGCAACTATGAAACCACAGTTACTAATGG AATTAAGACTTTNTAAAAAATTGCAAATGTACTTATTTGTATATGAAAGAGGTATTCAGC TATTAACTCAGTATTTAATAAACATTGATATGTAATTTTTACTTGAAATGGCCTAAGGTT TATAATACCAACTAGTTCATAGAGCTTTTTT | SEQ ID NO: 2815 |
| ACTN1 | ADXCRAD_M95178_at | GACGTCAGCCTGTACAGGCTCCCAGGGGTGGCGTCAAATGCTATTGAAATTGCGCTGAAT CGTATGCTTTTTCC | SEQ ID NO: 2816 |
| ACTN1 | ADXCRAD_M95178_x_at | GTGCGCCGTGCCCACAGATGTGAAATGAATGTAATCTAATAGAAGCCTAATCAGCCCACC ATGTTCTCCACTGAAAAATCCTCTTTCTTTGGGGTTTTTCTTTCTTTCTTTTTTGATTTT GCACTGGACGGTGACGTCAGCCTGTACAGGCTCCCAGGGGTGGCGTCAAATGCTATTGAA ATTGCGCTGAATCGTATGCTTTTTCCTTTTGA | SEQ ID NO: 2817 |
| EGFR | ADXCRAD_AU147861_at | AAGGACCCTGAAAAATGACTTCTCATTTCCTGCCTGCAGAAAAGAGAAATATTAGGATAG TGTTGTGTGCAAAAAAATGCAAGCTTGCAATGAGAGATGCAGAGTGTGAGGGAGAGAGGC ACGAAGGGGTGAGAAAAAAGACAGAGAATTTGAGGTTGACTCACGGCTTTGAAGGGAA AACAGGAAGANGAAGAAAGTCTGTCTNCCATGGGTCGGCAACCCACACTTTACACATTTT | SEQ ID NO: 2818 |
| EGFR | ADXCRAD_AU147861_x_at | ATGACTTCCTGAAGGACCCTGAAAAATGACTTCTCATTTCCTGCCTGCAGAAAAGAGAAA TATTAGGATAGTGTTGTGTGCAAAAAAATGCAAGCTTGCAATGAGAGATGCAGAGTGTGA GGGAGAGAGGCACGAAGGGGTGGAGAAAAAAGACAGAGAATTTGAGGTTGACTCACGGC TTTGAAGGGAAAACAGGAAGANGAAGAAAGTCTGTCTNCCATGGGTCGGCAACCCACACT TTACACATTTTTTCCATGGG | SEQ ID NO: 2819 |
| AHNAK | ADXCRAD_AA523289_at | GGCATTTTCACCTTGGGCATCTTCAGGTGCCAGTCTGGGCCATGAACATCCACATCTGGG GCATCAATGTCCACTTTGGGGCCCTTGATGTCAACTTCAGGGNGCTTTAGATCACCTTCC ATCTTAGGCAGAGAAACATCCACATCTCCTTTCACCTTAGGGCCTTTCAGATGCAAATCA | SEQ ID NO: 2821 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | AAGTCAGGCATGGAGATCTTGGGGGGCTTTGATGTTCATCTCTGGCATCTGTATTTAGGG CCTTCAGTTCGCATCTGGACTTCATATTCA | |
| RRBP1 | ADXCRAD_BE646396_at | GAGCAGAGCACATACCTGGTCCGAACTTACAAGTCTCCTTATAGCTTCTCTACAATCTC | SEQ ID NO: 2822 |
| RRBP1 | ADXCRAD_BE646396_s_at | GCAGGTCTGCACAGGGCCCGTGGCTGGGTCTCAGGGTCCTCTGAGGTAGTCAATGTCTCT CATTAAGGAAAAACAGGATGGACAAGATCCCTTGGCTTGAGAGAGAATGCCTCTCTTAAG GCACACGGTCCATGAGGAAGAAATCAGTGAAGTGTCCTCTGCATTAACGTCACTTTCAAA GAAGCTCCCNGGACATGAGAAAGAGTTCTCTGAGCAGAGCACATA | SEQ ID NO: 2823 |
| CAPN2 | ADXCRAD_AK023851_s_at | AGAATGGCAGTTGTCAGTCCTGTCCGTGTAACAGAGGAGTGAAGTGGTGAGGAGGGCAGG TCTAAGGCACTGGCAGCTCTTTTCCATGGATTTTGAACTCTGGAGGAAGGCAGCAACTAA ATAACTGTCTCATTCTGCTATTATGCATTGTATTAGCAAAGTGAAAATATAGTCTATCTG GTTACAAATAACACTAACTTGCTTAAAACTTTACATATCCTAGGAAATATCTCTACCCCT AGATTGCAATGTAGAGTCAACCCCATCT | SEQ ID NO: 2826 |
| COL5A2 | ADXCRAD_AU144167_at | ATTCATGTATATGAGACCTGCTCTACTTCAAAGCTGTAATCTTCTTAGTTGATAAACAAT ATTCTTAAACAAATGCCTTGTAAGGATTCTTAGTAAATGCAGCAGGGCAATTGCTATAGA CCAGTGCATCCTCAGGAGGCCTGGTTCCGGCCATTGCTAACAGGTTTATAAATGGTTTAT TAAAAAGAGGATAGGTCTCTCACAATGAAATTCGCTAA | SEQ ID NO: 2827 |
| COL5A2 | ADXCRAD_AU144167_x_at | ATTCATGTATATGAGACCTGCTCTACTTCAAAGCTGTAATCTTCTTAGTTGATAAACAAT ATTCTTAAACAAATGCCTTGTAAGGATTCTTAGTAAATGCAGCAGGGCAATTGCTATAGA CCAGTGCATCCTCAGGAGGCCTGGTTCCGGCCATTGCTAACAGGTTTATAAATGGTTTAT TAAAAAGAGGATAGGTCTCTCACAATGAAATTCGCTAA | SEQ ID NO: 2828 |
| LDLR | ADXCRAD_S70123_at | GAGGATGAGGTCCACATTTGCCACAACCAGGACGGCTACAGCTACCCCTCGAGACAGATG GTCAGTCTGGAGGATGACGTGGCGTGAACATCTGCCTGGAGTCCCGCCCCTGCCCAGAAC CCTTCCTGAGACCTCGCCGGCCTTGTTTTATTCAAAGACAGAGAAGACCAAAGCATTGCC TGCCAGAGCTTTGTTTTATATATTTATTCATCTGGGAGGCAGAACAGGCTTCGGACAGTG CCCA | SEQ ID NO: 2832 |
| PTRF | ADXCRAD_AI282511_s_at | CTTACTTGGGCAGAAATGTATTACTTATTGTGCCTATTTTCTTT | SEQ ID NO: 2833 |
| GALNT2 | ADXCRAD_AA604126_at | TAGGCTATGGGCTACCCAGATCTGCTGCAAGTGTTACATAGAACATTTCGTGTAAAGCAC ACGGCCCGGTGCCTGGCTCGTAGGAGGCACTCAGTAAACGGCGGTGATATTACAGACACA AAACACGAGGCTGATGTCTCCCTCAC | SEQ ID NO: 2836 |
| GALNT2 | ADXCRAD_AA604126_s_at | TGGGCAGACTTGTCAGGTGGTCTAATGTGAACAAAGCCACAGCCACGGGGAAGAACAACG TGCTTCAGAACCAGATCCAAACCTCAGCCCACCTCTGCCAGGTGCTGGCTTTCAGGCAAG ACTCTCTCTGAAGCTCGATTTGCCCTTTGGTAGGCTATGGGCTACCCAGATCTGCTGCAA GTGTTACATAGAACATTTCGTGTAAAGCACACGGCCCGGTGCCTGGCTCGTAGGAGGCAC TCAGTAAA | SEQ ID NO: 2837 |
| WDR1 | ADXCRAD_AW770902_at | TTCCCAGTCTTTGCACAGAGGTCATAAGAGGCAGAGGTGATGCAGGCAGGGTAAGGAAAC TTATAAGGAACCACCCCAGACCTAAGGAGGTACCAGCACCTGCAGGAAGCCTTCCTTAGA CCCCCGAAGCACAGACTATCCATCCCTTCTCCGTGGGGAACTAATGTCTCTCAAACACAG TGTACATATGGTTCACTGGAATCCCCTTCTTGGAGCTCTCTCCTTCTGGAATATTAGTTT CTACATGGCCACCATTATAGTCTTTCACTCTACAG | SEQ ID NO: 2839 |
| ALCAM | ADXCRAD_BE502785_at | TACTCGCTTTAGAAAAGTGTCCTGAGCAGTGCACTATTCATCTTTCTAATAACATGAAAG TGAAATAGAAAAAAAAAAAATACATGGGCCACTGGCAAATGCAGGATGCAGACTATTTG GGATGTTTTATGGAAACAGGCATGACTGCAAACACTTGGTTTGCACTTGGTTTGATTCAT ACAACGGATCGAGAAGTGTGGATGGTTTCTGGAAAGTGCCTTCTAAGCTGAAA | SEQ ID NO: 2840 |
| FNDC3B | ADXCRAD_N32832_at | GGGCATCTGATACAGGACGTTCTAACCCACAGGGCACTCGCACATGGGTAGGATGTGACT TCTATGTACTGCTCTGCTCTCACAGAGGCCACTCAACAGTGTAACACCAAAGTACATACA TGGCATTCAAAAAGGAAAAGCAAATTATGCTTTCCAAGCGGCAGTGTGTTTTACCTTATC AAAATCATCTGAGCAGTCAAGATGACCAAGCAGTCCATTT | SEQ ID NO: 2846 |
| LPP | ADXCRAD_AI079544_at | GACCTAAAACTGTCTCCAGGACACAAGGCTATTCCAAGCAACATTAAGAGAGAGCTCTGT AGGAAAAGAGGGTCTTGTCAACACAATTCTCAGAATAA | SEQ ID NO: 2852 |
| LPP | ADXCRAD_AI079544_s_at | GGACTCACAAGTCATACCCTACTAAACACCCATCAGATGGACTTGTCTACTTTATTGAGA AACAGAAGATAGACCTGCAAGTCCAGCTGTTCATCTACCTCCACCCCACAGCCCAAG CCACATTCCCACCCTTTGTGGATGAAGCTCAGGGATGCAGATCCCATTCCAAGATCC | SEQ ID NO: 2853 |
| SEPT7 | ADXCRAD_N39126_at | CAACAGAAAGATGGACTAAATATAAAGGGGGGAATTCCTGGACCTCCTTTGGGTGGCTAG ACTGGTANGTCATAGGCTAAGCCGGAAGGGTGG | SEQ ID NO: |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| | | | 2855 |
| SEPT7 | ADXCRAD_N39126_s_at | AAACAAGTACAATATCCTGGCATAAAACTATCTTTCAGACAAAATCCACCTGCTGTGTAT TAAAAAATGTAATACTTGAAAACTTCCTGCCTTGGGAGAGACTAAACCCGATTCATAATA CAAA | SEQ ID NO: 2856 |
| PDLIM7 | ADXCRAD_AI825846_at | GCAGGCCCGGATCTTGTTCTGAGCTTCGATGTGTGAGGCTACCCGCATTCTCGCCATC GATGCTCAGCACCCAGTCACCCACGGACACTCCGGCCTGCGCCGCTTTGCCCCCAGGAGT GAGCCGGGAAATGGAGAGGGGCACATTGAAGTCCTTGCCCCCTTGCAGCCGGAAGCCCCA AGGTGCTGGCCCCTCCAGCACTACTTTGAAGGAATCCATGA | SEQ ID NO: 2857 |
| SERPINH1 | ADXCRAD_NM_004353_at | GAGCCTTTGTTGCTAATCAAATCCGGGACTTGTTTGTACG | SEQ ID NO: 2858 |
| WDR1 | ADXCRAD_AF274954_at | GTAAGTTTAAAGCACCTGATTGGGAGTGTTTTGCGTGTTCGGAATCACTTGTAATGTTGG CTGAGACAATCCTTCCTTGCACTTTGAAACACTTTGAGCCTTTAAGAGATAGCCTGAGAA | SEQ ID NO: 2862 |
| NFIB | ADXCRAD_U70862_at | AAATGCATCAAGATATAGGTGTCCTTGCATTACCAACAATCCATAGTAAAACAATCATTT TACAAAGCCGCATACCAAAAGTAGACTAAAGTTTGAGCTGTCACAGATGGTAGGTCATTT CCAAACTTGGCCTGGTGGGAGGAAAAATGGCCTGCAGATAGCCAGGTGACAGACTGTTAC CTGAGGTTTGTTATATAAATGTGGGACTTAATAAACTGCTATGAGCT | SEQ ID NO: 2863 |
| PTPRK | ADXCRAD_AU145587_at | TGCTGGGCTGTTCTCTACCGAATACCATAAAACTGAATATTGTTCACCACTATGGTCGAT CTTTCTAACTTTAAAGAGTACACAACTGAACTCAATTACTCCAAAGATATGTGAAAACAC AGAAAAATGACCCCTGTTAAAGAGTAAACCTAGCTTTTGNTTTACTTTCCTTTTATATA AAAAAAGATGTACAGGGTTCTCTTCT | SEQ ID NO: 2864 |
| CDC14B | ADXCRAD_AK024886_at | GAACATTTGGGTTTTCAATCAGAAGGTTTGTGACAGCAAAGTCATTGGAATAAATCTTTC TTCTTGTGGAGATGAAATATGTGGCTAGTCTTCGTGAGGCAGTCACCAATTAATCAACTT CAGAAAAATAGAACCAAGCAGAATACTGAGGAGGGGTGCGTTACAGGAAATAAAAATGCT ATCAGAGGGCAACCCGCTCTGGTC | SEQ ID NO: 2865 |
| CDC14B | ADXCRAD_AK024886_x_at | TAGACAGTCCCTGTTGATGAACATTTGGGTTTTCAATCAGAAGGTTTGTGACAGCAAAGT CATTGGAATAAATCTTTCTTCTTGATGGAGATGAAATATGTGGCTAGTCTTCGTGAGGCA GTCACCAATTAATCAACTTCAGAAAAATAGAACCAAGCAGAATACTGAGGAGGGGTGCGT TACAGGAAATAAAAATGCTATCAGAGGGCAACCCGCTCTGGTC | SEQ ID NO: 2866 |
| ARID5B | ADXCRAD_AI289774_at | GTATAATAATTCTGTCTGCCTTGTCCAGCAGTAATTGCCAGGACTCAATGGGTTGATACA AATGAAGTAGCATGTCAGAATTAGCTATCATGATCATTGTTATTTCTTCTCTAAATTGGT GTTTTCCAAACCGTGGCATGCAGAGATGATTTTAGATGGTTCACAGGTAGACTTTTAA | SEQ ID NO: 2871 |
| CRIM1 | ADXCRAD_AA642418_s_at | GACTTATACTCATGAGGTCTACCTACAGTCCATTCCCATTTAGGGGAAGAGAAAGGAGAG GAAATGGCCAAGAAGTCCATAAGAAGTGGACAGTGCTTTAACTTTTTCAAGTTTTGCTAA CATATTTTATGTAAGTTATTCAATACCCCCATATTAAAGAGCAGCAGCTATTAAACACCA ACATTTATTAGCTGCTGGAAAGTAATAAATAACTTCAGCTAGTCCCCTTCAGTTTCCATA AAATTATAAAACCAACCATTTGACGTGAAAAAGCAGTTT | SEQ ID NO: 2873 |
| FNDC3B | ADXCRAD_AA703239_at | TGACAAAGCCACTCCAATTTTGCTGGCCAAAAGGAAAAGTGTCCCGGGCACAAGGGCTGA GTTAATGGAGAGCAAGTGGTAATTATCTGCTCTATTAGATCCCTCTTCCTCCAGCCCAAT TCATGGGAGGCTTGGTTTATAAAACACTGGCTGTCTGACTAAACCTCAACAACAGATTA ACCATAAATGCATTCCTGGAATTTACGTTCTTCCCGCCTCAGTGTTGTGTAAAATTATCA GGGAACACAGACCCACAGGGTCAGGA | SEQ ID NO: 2874 |
| VCAN | ADXCRAD_BF590263_at | ACATACTGTGTATTATTGTAGCTAGAGTCATTCCTTCTAAGCCAAAGGAGGTTTTATAAA AAAGAATCAATATTGGGCCAATCCCTTTGTGCCCTTTTTCTCTTTTTCTATGTGCATTTT ATTTTTTGTCTACTCTTCTTCAAGTTGCTCTAAACTGAAATTAGGGAAGGAGTCTCACTT TCCATTACAGGTTTTTCTTTAAACATTAAATTAAGTGGATAAGGATTCAAAGTCATC | SEQ ID NO: 2877 |
| SYNJ2 | ADXCRAD_AK026758_at | GGCACCTCTGGAGAGTTAGGACCCAGGCCTGCTCTCAGCACAATGAGAGGAAAACTAACC CTGAACTCCCTGCCACCCCCCACCCCTGGCCCCTGGAATGTGTTAGAGTGTAGAT | SEQ ID NO: 2884 |
| SYNJ2 | ADXCRAD_AK026758_x_at | GGCACCTCTGGAGAGTTAGGACCCAGGCCTGCTCTCAGCACAATGAGAGGAAAACTAACC CTGAACTCCCTGCCACCCCCCACCCCTGGCCCCTGGAATGTGTTAGAGTGTAGATTTGGA AAAGAAACCTGCGCCAGGCATGGTGCC | SEQ ID NO: 2885 |
| CDC42BPA | ADXCRAD_AK027000_at | AGGAGACTCCTAGAGTGGTCCCAATGGAAACCAATGAGGGCTTGGGATGCAGCAGGGGCA GAAGGAGAGAAGATGGTAGATTCTCCAGATATATTTTCAGAGTTAAAAGCAGTAAGACTT GATGATGAATTAGTCATGGAAAAGTAAGGGAGAGAGTTAAAGATGACTCCAGACTTCCT GCTAGGGCCTTAGTATGATACCATTTACTCCCATTTACCACCGTTTAAGAAGGGGCTGAG GCAGGACATTCCACGCATGTCCAAAGGTCCCGAGGTAGCAA | SEQ ID NO: 2886 |

TABLE 12-continued

Genes and corresponding Almac probesets predicting resistance to oxaliplatin. There can be multiple Almac IDs/probesets associated with a given gene.

| Gene | Almac Probe ID | Probe Sequence | SEQ ID NO |
|---|---|---|---|
| NFIB | ADXCRAD_T90642_s_at | CTTTGACCCTGCACAATGACCTTTGCATCAGCCAAACTCATTGCCATGACAACTCTTTGT ACTGTGTCCGTGCCACAGATCTGTTGGTCACAT | SEQ ID NO: 2887 |
| EGFR | ADXCRAD_AU156822_x_at | CCATGGCAATCTGTCTTGCTGCTGTGCAGTCCTTCCCTGGGTGGCTGCAGGGGCAAACAC AGGGTTTGTNGGTCCTGGGTCTTATAAAAATCAGGTACAAATTGACACNTNTATTTAAAA GGANAAATTGCCAAATGANACAAAATGTTTTCCTTATGCAAATTTCAT | SEQ ID NO: 2890 |
| BCL6 | ADXCRAD_AI733564_at | GGGCGCGGAGTGGAGATTGGCTCTCTGAGGTGGTCAGGGGCCCTGTGACAGCTTGGGACT TTCAGCACCTGGTTTGGGGTCATTTATCTGCTCAACTGTCAGACCCCCCACCCCCAAACC CCAGCCACCAACACAACCATCGTAGAAGGGAACACAACACAGAGGGTCTTTTTTCA | SEQ ID NO: 2891 |
| KCMF1 | ADXCRAD_R53065_at | TCGTCAGTGTGATATTTTCCAAGGTAAGTCTGAATCGTGAGTGGTCAGCACACATGGTGG GCTGCTATCCGATAGGACAATTCAACAGACACTGCTAATTAGCATACTATATATTTAAAA ATGGACTTTTATGGGGAAACTAGTGTCTTGTTAATTGTCATGAAAGGTTCTCGTGGGCAA AATTAAATGGATTCAAGGCTGGCCAGAATAGCTTTCATGACTAGGGGGTAAGAATCCATG AACTTTCCTTCAGTCCCTAGCGACAGTGGCTGAGG | SEQ ID NO: 2892 |
| MAPK1 | ADXCRAD_AA088464_at | AATAAAAACCTCAGCTGAAAAGCTAATAACTCCAGAATGCAGGTTGAAAGCAAGCTTAAA GGTCATCTAGGCTGGGGTCAGTAGCTCACGCCTGCAATCCCAACACCCTGGGAGGCCCAG GTGAGAGGACCGCTCGAGCCCNGGAGGTAAAGGCCGCAGCGAGCTATGACCGCGCCACTG CACACCAGCCTGTGCCACAAAGTAGA | SEQ ID NO: 2893 |
| MAPK1 | ADXCRAD_AA088446_x_at | AATAAAAACCTCAGCTGAAAAGCTAATAACTCCAGAATGCAGGTTGAAAGCAAGCTTAAA GGTCATCTAGGCTGGGGTCAGTAGCTCACGCCTGCAATCCCAACACCCTGGGAGGCCCAG GTGAGAGGACCGCTCGAGCCCNGGAGGTAAAGGCCGCAGCGAGCTATGACCGCGCCACTG CACACCAGCCTGTGCCACAAAGTAGA | SEQ ID NO: 2894 |
| MICALL1 | ADXCRAD_W46406_at | ACAGAGCAGACAGACCAGTGATGACCATGGGCGGGACGAAGCCTCTTCCCTGGACCGGGG TGGCAGAGGAAAGCCTAAGTGAGGGGTCAGACTATAAACGTTAAGGAACCCGAGATNAGC ACCTGCTTCAAGTGCACCCTTCCTACCTNACAACCAGGGACCAGAACTGCAANCTTTGGG GACAGCACTTGGGAGCAGCTAACAGAGCACTCACCTGCCCAAGANGGCCGTCGCAGCCC TGGTCCTGGCAAGGGAAGCT | SEQ ID NO: 2898 |
| EHD2 | ADXCRAD_AI417917_at | GAGCAGATCACCTGAATTGCGAGTCGAGACCAGCT | SEQ ID NO: 2899 |
| EHD2 | ADXCRAD_AI417917_s_at | TGGCCCAGCAATCCTTAAGTCCAGATTACCAGCTGTGGGGAGGCTTCCAGGGGGCCAGGA GCAGGCTTGGCAGTTCCAGCCACAGACACGTGGGTGAGGACGGAAATATCTCCAAGGGGG CACAGTAT | SEQ ID NO: 2900 |
| EHD2 | ADXCRAD_AI417917_x_at | GGCCCAGCAATCCTTAAGTCCAGATTACCAGCTGTGGGGAGGCTTCCAGGGGGCCAGGAG CAGGCTTGGCAGTTCCAGCCACAGACAGGTGGGTGAGGACGGAAATATCTCCAAGGGGC ACAGTATCAGAGGAGCAGGATGGAAGGGCTTTTCTGCCTGCTACGGATCCTTTTAAAGAA ATGGTGTGAAGCCGGCCGGNGCTCATGCCTGAATCCCATCACTTTGGAGGCCGAGCGAGC AGATCACCTGAATTGCGAGTCGAGACCAGCTGCCAAC | SEQ ID NO: 2901 |

Sequencing

Expression levels of biomarkers may be determined using sequencing technologies, such as next generation sequencing platforms (e.g., RNA-Seq), as described in Mortazavi et al., Nat. Methods 5: 621-628, 2008, hereby incorporated by reference. Sequencing methods for expression profiling offer broader dynamic range than microarray and offer the possibility of quantifying sequences for which pre-designed probes are not available (e.g., novel transcripts, novel splice variants, or low-abundance transcripts). RNA-Seq is a robust technology for monitoring expression by direct sequencing the RNA molecules in a sample. In certain embodiments, this methodology includes fragmentation of RNA to an average length of, e.g., 200 nucleotides, conversion to cDNA by random priming, and synthesis of double-stranded cDNA (e.g., using the Just cDNA DoubleStranded cDNA Synthesis Kit from Agilent Technology). Then, the cDNA is converted into a molecular library for sequencing by addition of sequence adapters for each library (e.g., from Illumina®/Solexa), and the resulting 50-100 nucleotide reads are mapped onto the genome.

Exemplary sequencing platforms suitable for use according to the invention include, but are not limited to, 454 pyrosequencing, Illumina sequencing by synthesis, SOLiD sequencing, Ion Torrent sequencing, and PacBio RS sequencing.

Other Systems

Expression levels of biomarkers may, alternatively, be determined using any other methods known in the art. For example, biomarker expression may be assayed using a NanoString nCounter system. In this system, a capture probe and reporter probe are hybridized to a target nucleic acid (e.g., a biomarker of the invention). The capture probe is used to immobilize the probe/target complex for isolation and data collection, and the reporter probe carries a combination of fluorescent moieties representing a "color code," which can be identified and tabulated to count the number of such target molecules present in the original solution. In some embodiments, biomarker expression is assayed using a protein array to measure the expression of one or more polypeptide gene products (e.g., proteins, protein fragments, protein complexes, or peptides) of the biomarker genes. The protein array can include protein binding moieties (e.g., antibodies, antibody fragments, scFvs, or other protein binding agents) capable of detectably binding to such polypeptide gene products, such as those described herein.

Methods of Treatment

The diagnostic methods of the present invention permit the assessment of whether a given subject is likely to be sensitive or resistant to treatment with a target drug, and can therefore be used to direct the subject's treatment. Exemplary target drugs include chemotherapeutic agents, such as 5-FU, capecitabine, tegafur, irinotecan, oxaliplatin, cetuximab, leucovorin, SN-38, everolimus, temsirolimus, bleomycin, lomustine, depsipeptide, carboplatin, bortezomib, erlotinib, gemcitabine, mitoxantrone, cisplatin, busulfan, epirubicin, arsenic trioxide, bendamustine, vincristine, fulvestrant, teniposide, adriamycin, decitabine, estramustine, etoposide, azaguanine, aclarubicin, mitoxantrone, mitomycin, paclitaxel, taxotere, dexamethasone, ara-c, methylprednisolone, methotrexate, methyl-gag, belinostat, carboplatin, idarubicin, melphalan, IL4-PR38, valproic acid, all-trans retinoic acid (ATRA), cytoxan, topotecan, suberoylanilide hydroxamic acid (SAHA, vorinostat), leukeran, fludarabine, vinblastine, dacarbazine, hydroxyurea, tegafur, daunorubicin, mechlorethamine, streptozocin, carmustine, mercaptopurine, dactinomycin, tretinoin, ifosfamide, tamoxifen, floxuridine, thioguanine, PSC 833, herceptin, bevacizumab, celecoxib, iressa, anastrozole, letrozole, rituximab, radiation, and histone deacetylase (HDAC) inhibitors, as well as prodrugs, derivatives, metabolites, enantiomers, and analogs thereof. A subject found to be sensitive to a target drug according to the methods of the invention may be preferentially selected for treatment with the target drug or drug combinations including the target drug. Thus, the present invention further features methods of treatment that leverage the improved understanding of the subject's drug responsiveness profile to improve outcomes. For example, a subject can be identified as sensitive to a target drug by determining the expression level of one or more biomarkers of sensitivity and/or resistance in a biological sample obtained from the subject, and subsequently administered the target drug (e.g., alone or as part of a combination therapy). Alternatively, a subject can be, e.g., identified as resistant to a target drug by determining the expression level of one or more biomarkers of sensitivity and/or resistance in a biological sample obtained from the subject, and subsequently administered a drug other than the target drug or a combination therapy predicted to have a greater effect than administration of the target drug alone. In some embodiments, the level of expression of one or more biomarkers of sensitivity to a target drug are assayed in a sample from a subject. In other embodiments, the level of expression of one or more biomarkers of resistance to a target drug are assayed in a sample from a subject. In still other embodiments, the level of expression of one or more biomarkers of sensitivity and the level of expression of one or more biomarkers of resistance to a target drug are assayed in a sample from a subject.

Administration and Dosage of Target Drugs

Routes of administration, frequency of administration, and/or dosage of target drugs (e.g., 5-FU, irinotecan, or oxaliplatin) will vary from individual to individual, and may be readily established using standard techniques. Once a patient has been determined to be responsive to one or more target drugs, according to the methods described herein, the target drug(s) of the invention can be administered to the patient by the usual means known in the art, for example, by injection, intravenously, orally, subcutaneously, intraperitoneally, intramuscularly, by infusion, by infiltration, by irrigation, intra-articularly, by inhalation, topically, rectally, vaginally, cutaneously, nasally, transdermally, or by ocular administration and the like. In certain embodiments, the target drug is administered intravenously. In particular embodiments, 5-FU, irinotecan, and/or oxaliplatin are administered by intravenous injection. For administration by injection, infiltration, or infusion, a target drug may be suspended or dissolved, as known in the art, in a vehicle suitable for injection, infiltration, or infusion. Such vehicles include, e.g., isotonic saline, buffered or unbuffered, and the like. Depending on the intended use, they also may contain other ingredients, including other active ingredients, such as isotonicity agents, sodium chloride, pH modifiers, colorants, preservatives, antibodies, enzymes, antibiotics, antifungals, antivirals, other anti-infective agents, and/or diagnostic aids such as radio-opaque dyes, radiolabeled agents, and the like, as known in the art. Compositions including a target drug may include a simple solution or suspension of the target drug or a pharmaceutically acceptable salt of the target drug, in distilled water or saline. Alternatively, a target drug may be delivered by other means, such as intranasally, by inhalation, or in the form of liposomes, nanocapsules, vesicles, and the like. Compositions for intranasal administration usually take the form of drops, sprays containing liquid forms (solutions, suspensions, emulsions, liposomes, etc.) of the active compounds. Administration by inhalation generally involves formation of vapors, mists, dry powders or aerosols, and again may include solutions, suspensions, emulsions and the like containing the active therapeutic agents.

Administration of a target drug of the invention to a subject can be performed according to, e.g., courses of therapy standard in the art. A target drug can be administered at a frequency of, for example, at least once hourly, once daily, twice daily, once weekly, once every two weeks, once every three weeks, once every four weeks, once monthly, once every two months, once every three months, once every six months, or once every year. The administration can be repeated at such a frequency for a certain period of time, followed by a period without treatment. In certain embodiments, a target drug is administered once daily for up to four days. In particular embodiments, the administration is repeated every 30 days or every month. Such repeated administrations can occur over a course of therapy lasting a specified length of time (e.g., at least 1 week, 2 weeks, 3 weeks, 1 month, 2 months, 3 months, 6 months, 8 months, 10 months, 12 months, 18 months, 24 months, 36 months, 48 months, or 60 months). In certain embodiments, administration of a target drug is repeated for at least 12 months or 60 months.

A subject may be monitored or assessed according to the methods of the invention before, during, or after treatment. For example, a subject may be assessed for target drug responsiveness between administrations of the target drug. Multiple assessments can be performed over the course of therapy, and the results combined to determine change in responsiveness of the subject to the target drug over time. Each of the assessments can involve determining the expression level of the same biomarkers of responsiveness, or can involve determining the expression level of different biomarkers (e.g., selecting one or more distinct biomarkers per assessment, or varying only a subset of the biomarkers tested between individual assessments).

A suitable dose or therapeutic amount of a given target drug is generally an amount of a compound that, when administered as described above, is capable of treating a disease (e.g., by killing or slowing the growth of cancers or cancer cells). In general, an appropriate dosage and treatment regimen provides the active compound(s) in an amount sufficient to provide therapeutic and/or prophylactic benefit. In certain embodiments, a dose includes about 0.1-5000 mg of the active ingredient (e.g., a target drug), for example, about 0.1 mg, 0.5 mg, 1 mg, 2 mg, 3 mg, 4 mg, 5 mg, 6 mg, 10 mg, 12 mg, 15 mg, 20 mg, 30 mg, 40 mg, 50 mg, 60 mg, 70 mg, 80 mg, 85 mg, 90 mg, 100 mg, 125 mg, 130 mg, 150 mg, 175 mg, 180 mg, 200 mg, 250 mg, 300 mg, 350 mg, 370 mg, 400 mg, 450 mg, 500 mg, 600 mg, 700 mg, 800 mg, 900 mg, 1000 mg, 1500 mg, 2000 mg, 2500 mg, 3000 mg, 4000 mg, or 5000 mg of the active ingredient. In particular embodiments, the dosage is 800 mg per day. Dosage may vary from subject to subject. For example, a drug may be administered in a particular amount per amount of a subject's body weight, e.g., milligram per kilogram of the subject's body weight (mg/kg), or a drug may be administered in a particular amount per amount of a subject's body surface area, e.g., milligrams per square meter of the subject's body surface area (mg/m$^2$). Body surface area can be estimated, for example, based on a subject's height and weight.

Therapeutic and/or prophylactic effect (e.g., benefit) can be monitored by establishing an improved clinical outcome (e.g., more frequent remissions, complete or partial, longer disease-free survival, decreased morbidity, or an improvement in one or more standard tests or assays known in the art for the assessment of the disease, condition, or disorder status) in treated patients as compared to non-treated patients.

A therapeutic amount of a target drug described herein refers to an amount effective to yield the desired therapeutic response, such as, for example, an amount effective to delay the growth of a cancer or to cause a cancer to shrink or not metastasize. If what is administered is not the target drug but an enantiomer, prodrug, salt, or metabolite of the target drug, then the term "therapeutically effective amount" means an amount of such material that produces in the patient the same blood concentration of the active component of the target drug in question that is produced by the administration of a therapeutically effective amount of the target drug itself.

Target drugs, such as those described herein, may be used alone or in combination with one or more additional therapeutic agents suitable for treatment of a particular indication. For example, a target drug of the invention may be co-administered to a subject who has, or is at risk for developing, cancer with conventional anti-cancer therapeutic regimens such as surgery, irradiation, chemotherapy and/or bone marrow transplantation (autologous, syngeneic, allogeneic, or unrelated) or in combination with conventional therapeutic regimens to treat age-related cataracts, spinal injuries, wounds or congenital defects. Such combination therapies are described in further detail below.

Subjects that can be treated with a target drug as described herein, and/or the pharmaceutically acceptable salts, prodrugs, enantiomers, and metabolites of such compounds, according to the methods of the invention include, for example, patients that have been diagnosed as having any of the diseases or disorders described herein. As used herein, a "patient" or a "subject" refers to any animal (e.g., a mammal), preferably a human. The sensitivity and/or resistance of a subject to treatment with a target drug can be determined using the devices and methods of the invention, e.g., by measuring the expression level of one or more biomarkers of sensitivity and/or resistance to the target drug (e.g., 5-FU, irinotecan, or oxaliplatin). A subject may be suffering from, in remission from, or susceptible to developing a cancer (e.g., a colon cancer). Accordingly, pharmaceutical compositions including a target drug may be used to prevent the development or progression of a cancer or other disorder, or delay its appearance or reappearance, or to treat a patient afflicted with a cancer. A cancer or other disorder treatable by the methods of the invention may be diagnosed using the diagnostic methods described herein and/or by criteria generally accepted in the art. In the case of cancer, target drugs may be administered either prior to or following surgical removal of primary or other tumors and/or treatment such as administration of radiotherapy or conventional chemotherapeutic drugs, or bone marrow transplantation (autologous, allogeneic, or syngeneic).

5-Fluorouracil 5-fluorouracil (5-FU) is an antineoplastic suicide inhibitor commonly used as a chemotherapeutic agent in the treatment of cancer (e.g., colon cancer, rectal cancer, anal cancer, breast cancer, esophageal cancer, stomach cancer, pancreatic cancer, and skin cancer). 5-FU can be administered to a subject in, e.g., its active form, or administered in the form of a prodrug, such as capecitabine or tegafur. The effective dosage and maximally-tolerated dosage of 5-FU can vary dramatically from subject to subject. As such, there is a need for methods, such as those described herein, for assessing a subject's responsiveness (e.g., sensitivity or resistance) to 5-FU treatment.

5-FU is generally administered to subjects intravenously. 5-FU packaged for intravenous administration is commonly available in 50 mL or 100 mL packages containing 50 mg/mL of 5-FU dissolved in saline solution (water, pH adjusted to 8.6 to 9.4 with sodium hydroxide). The daily dosage of 5-FU delivered to a subject generally depends on the subject's weight, e.g., 12 mg 5-FU daily per kilogram subject weight (mg/kg), but is not to exceed 800 mg per day. A standard dosage regimen for 5-FU includes, e.g., intravenous administration of 12 mg/kg once daily for four successive days, followed by 6 mg/kg on the $6^{th}$, $8^{th}$, $10^{th}$, and $12^{th}$ days unless toxicity occurs. Subjects identified as "poor risk" may be, e.g., administered only 6 mg/kg daily for 3 days, followed by 3 mg/kg on the $5^{th}$, $7^{th}$, and $9^{th}$ days unless toxicity occurs. A maintenance dosage of 10-15 mg/kg per week can be administered as a single dose when toxic signs from an initial dosage regimen have subsided. A course of treatment can be repeated, e.g., every 30 days after the last day of the previous round of treatment. Such repetition can occur up to, e.g., 9 to 45 times over periods of about 12 to 60 months.

5-FU can also be administered orally (e.g., in the form of the produg capecitabine, which is enzymatically converted to 5-FU upon ingestion) for the treatment of, e.g., colon cancer, rectal cancer, breast cancer, gastric cancer, or esophageal cancer. In some embodiments, capecitabine is orally administered in the form of tablets. In certain embodiments, each tablet contains 150 mg capecitabine or 500 mg capecitabine. In particular embodiments, tablets are administered twice daily, once in the morning and once in the evening (e.g., after a meal), for a course of 14 days, followed by no treatment for 7 days. This cycle of 14 days and 7 days can be, e.g., repeated every 3 weeks. The total daily dosage of capecitabine administered to a subject can be, e.g., 2500 mg/m$^2$. Another 5-FU prodrug, tegafur, is used to treat, for example, stomach cancer, breast cancer, gall bladder cancer, lung cancer, colon cancer, rectal cancer, cancer of the head and neck, liver cancer, or pancreatic cancer. In certain embodiments, tegafur is administered alongside one or more additional therapeutic agents (e.g., gimeracil, oteracil, and/or uracil). The combination of tegafur and uracil can be, for example, orally administered at a daily dosage of 300-400 mg/mg$^2$ in cycles of, e.g., 5 days of treatment followed by 2 days off treatment, or at a daily dosage of 300-600 mg/mg$^2$ in cycles of, e.g., 28 days of treatment followed by one week off treatment. In certain embodiments, tegafur and uracil can be administered on a long term basis (e.g., for about 6 months up to about 11 years).

5-FU treatment can be combined with other cancer treatments. For example, 5-FU can be administered in combination with leucovorin, irinotecan, and/or oxaliplatin. In certain embodiments, leucovorin is administered intravenously at 200 mg/m$^2$ over a minimum of 3 minutes, followed by intravenous administration of 5-FU at 370 mg/m$^2$; or leucovorin is administered intravenously at 20 mg/m$^2$ followed by intravenous administration of 5-FU at 425 mg/m$^2$. Such treatments can be performed daily for, e.g., a five day course of treatment. A course of treatment may be repeated at, e.g., four week intervals for two courses, followed by repetition at, e.g., 4-5 week intervals. 5-FU and leucovorin are generally administered separately to avoid precipitation. In some embodiments, 5-FU can be administered in combination with irinotecan, e.g., in a FOLFIRI regimen, as described in detail below. In alternate embodiments, 5-FU can be administered in combination with oxaliplatin, e.g., in a FOLFOX regimen, such as the FOLFOX4 regiment described in detail below.

Irinotecan

Irinotecan, a topoisomerase I inhibitor, is a chemotherapeutic agent commonly used in the treatment of cancers (e.g., colon cancer, rectal cancer, pancreatic cancer, ovarian cancer, glioblastoma, or lung caner). In the body, irinotecan is converted into its metabolite, SN-38, which has significantly greater potency as a topoisomerase inhibitor than irinotecan. Irinotecan monotherapy can include, for example, 125 mg/m$^2$ intravenous infusion over 90 minutes on each of days 1, 8, 15, 22, followed by 2 weeks off treatment. Alternatively, irinotecan monotherapy can include, e.g., 350 mg/m$^2$ intravenous infusion over 30-90 minutes, administered once every three weeks. Irinotecan is often administered in combination with other chemotherapeutic agents (e.g., 5-FU and/or leucovorin). In certain embodiments, irinotecan is administered in combination with 5-FU and leucovorin, e.g., in a FOLFIRI regimen. An exemplary FOLFIRI cycle includes, in order, (i) intravenous co-administration of irinotecan (180 mg/m$^2$ over 90 minutes) with leucovorin (400 mg/m$^2$ (or 2×250 mg/m$^2$) over 120 minutes, (ii) intravenous administration of 5-FU (400-500 mg/m$^2$ bolus), and (iii) intravenous administration of 5-FU (2400-3000 mg/m$^2$ intravenous infusion over 46 hours). Such a cycle can be repeated, e.g., every two weeks. An alternate FOLFIRI regimen can include, for example, a 180 mg/m$^2$ intravenous infusion of irinotecan over 30-90 minutes, followed by infusion with leucovorin and 5-fluorouracil, on each of days 1, 15, and 29, with the subsequent cycle beginning on day 43. A FOLFIRI cycle can also include, e.g., 125 mg/m$^2$ intravenous infusion of irinotecan over 90 minutes, followed by bolus doses of leucovorin and 5-fluorouracil, on each of days 1, 8, 15, and 22. Dosages can vary from cycle to cycle or from subject to subject, as required.

Oxaliplatin

Oxaliplatin is a platinum-based antineoplastic agent commonly used to treat cancers (e.g., colon cancer and rectal cancer). Oxaliplatin can be administered as a monotherapy, e.g., by intravenous administration of 130 mg/m$^2$ over two hours, once every three weeks. More commonly, however, oxaliplatin is given in combination with, e.g., 5-FU and/or leucovorin. For example, the FOLFOX4 regimen is a two-day regimen recommended for, e.g., stage III colon cancer. On day 1 of FOLFOX4, simultaneous administration of 85 mg/m$^2$ of oxaliplatin and 200 mg/m$^2$ of leucovorin by intravenous infusion over two hours, followed by 400 mg/m$^2$ 5-FU delivered as an intravenous bolus over 2-4 minutes, followed by 600 mg/m$^2$ of 5-FU as a 22-hour, continuous intravenous infusion. On day 2 of FOLFOX4, 200 mg/m$^2$ of leucovorin is administered by intravenous infusion over two hours, followed by a 400 mg/m$^2$ 5-FU bolus given intravenously over 2-4 minutes, followed by 600 mg/m$^2$ of 5-FU as a 22-hour, continuous intravenous infusion. Such two-day cycles can be repeated about 12 times, once every two weeks. Dosages can vary from cycle to cycle or from subject to subject, as required.

Combination Therapies

Once a patient is assessed to be responsive to one or more target drugs, according to the methods of the invention, one or more of the target drug(s) (e.g., 5-FU, irinotecan, or oxaliplatin, or an analog thereof) can be administered in combination with one or more additional therapies, including but not limited to therapeutic agents (e.g., compounds, pharmaceuticals, or compositions), treatments, therapies, medical procedures, and combinations thereof. Such therapies can also be administered in lieu of treatment with the target drug (e.g., 5-FU, irinotecan, or oxaliplatin, or analog thereof), if the subject is, for example, identified as resistant to the target drug according to the methods of the invention. Methods, devices, and kits of the present invention can be used to determine the responsiveness of a subject to such combination therapies. In such combination therapies, target drugs of the invention may be formulated with or administered concurrently with, prior to, or subsequent to, one or more other desired therapies. The particular combination of therapies to employ in a combination regimen will take into account compatibility of the desired therapeutics and/or procedures and the desired therapeutic effect to be achieved. It will also be appreciated that the therapies employed may achieve a desired effect for a condition, disease, or disorder, or they may achieve different effects (e.g., control of any adverse effects).

In general, for use in treatment, the target drugs described herein may be used alone, as mixtures of two or more agents, or in combination with other agents, compounds, and/or pharmaceuticals. Examples of other agents that can be combined with the compounds described herein include agents that are known to be used for the treatment of cancer (e.g., colon cancer). Other potential agents to combine with the compounds described herein can include agents for the treatment of different yet associated or related symptoms or indications. Depending on the mode of administration, the agents may be formulated into suitable compositions to permit facile delivery. Each component of a combination therapy may be formulated in a variety of ways that are known in the art. For example, the first and second agents of the combination therapy may be formulated together or separately. The target drug of the present invention and additional agent may be suitably administered to the patient at one time or over a series of treatments.

The combination therapy may provide "synergy" and prove "synergistic," i.e., the effect achieved when the active ingredients used together is greater than the sum of the effects that results from using the ingredients separately. A synergistic effect may be attained when the active ingredients are: (1) co-formulated and administered or delivered simultaneously in a combined, unit dosage formulation; (2) delivered by alternation or in parallel as separate formulations; or (3) by some other regimen. When delivered in alternation therapy, a synergistic effect may be attained when the compounds, agents, and/or treatments are administered or delivered sequentially, e.g., by different injections in separate syringes. Suitable dosages for any of the above co-administered agents are those presently used and may be lowered due to the combined action (synergy) of a compound of the present invention and other co-administered agents or treatments.

Each component of a combination therapy, as described herein, may be formulated in a variety of ways that are known in the art. For example, the first and second agents of the combination therapy may be formulated together or separately. The individually or separately formulated agents can be packaged together as a kit. Non-limiting examples include, but are not limited to, kits that contain, e.g., a liquid in a container (e.g., a bag or a vial), two pills, a pill and a powder, a suppository, two topical creams, etc. The kit can include optional components that aid in the administration of the unit dose to patients, such as vials for reconstituting powder forms, syringes for injection, customized IV delivery systems, inhalers, etc. Additionally, the unit dose kit can contain instructions for preparation and administration of the compositions. The kit may be manufactured as a single use unit dose for one patient, multiple uses for a particular patient (at a constant dose or in which the individual compounds may vary in potency as therapy progresses); or the kit may contain multiple doses suitable for administration to multiple patients ("bulk packaging"). The kit components may be assembled in cartons, blister packs, bottles, tubes, and the like. Two or more components may be mixed together in a liquid, tablet, capsule, or other vehicle, or may be partitioned.

Exemplary therapies that can be combined with target drugs of the present invention can include, for example, drugs (e.g., chemotherapeutic agents) and/or non-pharmacological therapies (e.g., surgery or radiation therapy). Chemotherapeutic agents suitable for, e.g., combination with target drugs of the present invention (in particular, 5-FU, irinotecan, and/or oxaliplatin) may include, for example, one or more of the following: 5-FU, capecitabine, tegafur, irinotecan, oxaliplatin, cetuximab, leucovorin, SN-38, everolimus, temsirolimus, bleomycin, lomustine, depsipeptide, carboplatin, bortezomib, erlotinib, gemcitabine, mitoxantrone, cisplatin, busulfan, epirubicin, arsenic trioxide, bendamustine, vincristine, fulvestrant, teniposide, adriamycin, decitabine, estramustine, etoposide, azaguanine, aclarubicin, mitoxantrone, mitomycin, paclitaxel, taxotere, dexamethasone, ara-c, methylprednisolone, methotrexate, methyl-gag, belinostat, carboplatin, idarubicin, melphalan, IL4-PR38, valproic acid, all-trans retinoic acid (ATRA), cytoxan, topotecan, suberoylanilide hydroxamic acid (SAHA, vorinostat), leukeran, fludarabine, vinblastine, dacarbazine, hydroxyurea, tegafur, daunorubicin, mechlorethamine, streptozocin, carmustine, mercaptopurine, dactinomycin, tretinoin, ifosfamide, tamoxifen, floxuridine, thioguanine, PSC 833, herceptin, bevacizumab, celecoxib, iressa, anastrozole, letrozole, rituximab, radiation, and histone deacetylase (HDAC) inhibitors.

Methods for Identifying Biomarkers of Drug Sensitivity or Resistance

The invention features methods for identifying biomarkers of sensitivity or resistance to a drug of interest (e.g., 5-FU, irinotecan, or oxaliplatin). Such methods can involve, for example, an algorithm based on growth inhibition values (GI50) of cell lines (e.g., NCI60 cell lines) subjected to treatment with a drug (e.g., 5-FU, irinotecan, oxaliplatin, or a metabolite thereof), followed by measurement of gene expression (e.g., using an Affymetrix HG-U133A array).

In certain embodiments, the gene expression measurements of NCI60 cancer cell lines are obtained from a publically available database (e.g., the National Cancer Institute and the Massachusetts Institute of Technology). Each dataset is normalized so that sample expression measured by different chips could be compared. The preferred method of normalization is the logit transformation, which is performed for each gene y on each chip:

$$\log it(y) = \log [(y - background)/(saturation - y)],$$

where background is calculated as the minimum intensity measured on the chip minus 0.1% of the signal intensity range: $min - 0.001*(max - min)$, and saturation is calculated as the maximum intensity measured on the chip plus 0.1% of the signal intensity range: $max + 0.001*(max - min)$. The resulting logit transformed data is then z-transformed to mean zero and standard deviation 1.

Next, gene expression is correlated to cancer cell growth inhibition. Growth inhibition data (GI50) of the NCI60 cell lines in the presence of any one of thousands of tested compounds is obtained from the NCI. The correlation between the logit-transformed expression level of each gene in each cell line and the logarithm of GI50 (the concentration of a given compound that results in a 50% inhibition of growth) can be calculated, e.g., using the Pearson correlation coefficient or the Spearman Rank-Order correlation coefficient. Instead of using GI50s, any other measure of patient sensitivity to a given compound may be correlated to a subject's gene expression levels. Since a plurality of measurements may be available for a single gene, the most accurate determination of correlation coefficient can be, e.g., the median of the correlation coefficients calculated for all probes measuring expression of the same gene.

The median correlation coefficient of gene expression measured on a probe to growth inhibition or patient sensitivity is calculated for all genes, and genes that have a median correlation above, e.g., 0.3, 0.4, 0.5, 0.6, 0.7, 0.8, 0.9, 0.95, or 0.99 can be used as biomarker genes. Preferably, the correlation coefficient of a biomarker gene will exceed 0.3. This can be repeated for multiple drug compounds to be tested. The result is a list of marker genes that correlates to sensitivity for each drug tested. Such methods are further described in PCT Publication No. WO 2011/135459, which is incorporated herein in its entirety.

Devices and Kits

The present invention features devices and kits for determining the expression level of one or more biomarkers of sensitivity and/or resistance to a target drug. Devices of the invention can include, for example, microarrays, protein arrays, or chips containing one or more probes suitable for hybridization to one or more biomarkers of interest. Kits of the invention can include, for example, reagents for microarray analysis of gene expression, reagents for sequencing (e.g., Sanger sequencing or next generation sequencing), and/or reagents for PCR-based techniques, as well as instructions for their use. Exemplary next generation sequencing platforms suitable for use with the present invention include the MiSeq and HiSeq platforms (Illumina), the SOLiD platform (Applied Biosystems), Roche 454 pyrosequencing, Ion Torrent/Ion Proton (Life Technologies), PacBio RS, Oxford Nanopore, and other NGS platforms known in the art.

A device or kit of the invention may include pre-designed probes and/or primers targeting the one or more biomarkers of interest such as those described herein (see, e.g., Tables 1-6). Such probes can be, e.g., oligonucleotide probes identical to or sharing at least 85%, 90%, 95%, or 99% identity to the one or more biomarkers or to a nucleic acid complementary to the one or more biomarkers (e.g., the probe includes at least about 5, 10, 15, or 20 contiguous nucleic acid residues that are complementary to the one or more biomarkers). The probes can be complementary to, e.g., at least 5, 8, 12, 20, 30, 40, 60, 80, 100, 150, or 200 consecutive nucleotides (or nucleotide analogs) of the one or more of the biomarkers. The probes may be, e.g., 5-20, 25, 5-50, 50-100, or over 100 nucleotides long, and may be deoxyribonucleic acids (DNA) or ribonucleic acids (RNA). Consecutive nucleotides within the probes (e.g., 5-20, 25, 5-50, 50-100, or over 100 consecutive nucleotides) may also appear as consecutive nucleotides in one or more of the biomarkers described herein beginning at or near, e.g., the first, tenth, twentieth, thirtieth, fortieth, fiftieth, sixtieth, seventieth, eightieth, ninetieth, hundredth, hundred-fiftieth, two-hundredth, five-hundredth, or one-thousandth nucleotide of one or more of the biomarkers listed in one or more of Tables 1-6 (e.g., NT5E). In certain embodiments, devices of the present invention can include microarrays having one or more oligonucleotide probes, as described in detail below.

Probes that may be employed on devices (e.g., microarrays) of the invention include oligonucleotide probes having sequences complementary to or identical to (or sharing at least 85%, 90%, 95%, or 99% identity to) any of the target biomarker sequences described herein (e.g., NT5E). Additionally, probes employed on devices (e.g., microarrays) of the invention may also include proteins, peptides, or antibodies that selectively bind any of the oligonucleotide probe sequences or their complementary sequences. Exemplary biomarkers of drug sensitivity and resistance are listed in Tables 1-6 alongside exemplary Affymetrix probes useful for detecting the associated biomarkers.

Any of the devices or kits described herein can be adapted to include a solid support. Exemplary solid supports include a glass or a polymer surface, including one or more of a well, a plate, a wellplate, a tube, an array, a bead, a disc, a microarray, a protein array, or a microplate. In particular, the solid support can be adapted to allow for automation of any one of the methods described herein (e.g., PCR, microarray, next generation sequencing, or NanoString). Alternatively, microfluidics or microdroplets could be used (e.g., for polony-based sequencing or 454 pyrosequencing).

Devices

Devices of the present invention can be useful, e.g., for detecting the level of expression of at least one biomarker of responsiveness (e.g., sensitivity or resistance) to a target drug (e.g., 5-FU, irinotecan, or oxaliplatin). In some embodiments, the device includes at least one single-stranded nucleic acid (e.g., a probe) having at least 85% sequence identity (e.g., 85%, 90%, 95%, 97%, 98%, 99%, or 100% sequence identity) to a nucleic acid sequence that is complementary or identical to at least 5 consecutive nucleotides of one or more biomarkers, in which the at least one single-stranded nucleic acid is sufficient for the detection of the level of expression of the one or more biomarkers. The device may detect the expression level of a given biomarker by specific hybridization between the single-stranded nucleic acid and the biomarker (e.g., an mRNA, genomic DNA, or non-coding RNA), a nucleic acid encoding the biomarker (e.g., an mRNA), or a complementary nucleic acid thereof. In certain embodiments, the device includes a microarray. In alternate embodiments, the device includes reagents and materials for next generation sequence (e.g., sequencing by synthesis). In further embodiments, the device includes NanoString reagents and at least one nCounter cartridge. In additional embodiments, the device includes a protein array, which contains one or more protein binding moieties (e.g., proteins, antibodies, nucleic acids, aptamers, affibodies, lipids, phospholipids, small molecules, labeled variants of any of the above, and any other moieties useful for protein detection as well known in the art) capable of detectably binding to the polypeptide gene product(s) of one or more biomarkers of sensitivity and/or resistance (e.g., those shown in Tables 1-6) to treatment with a target drug (e.g., 5-FU, irinotecan, or oxaliplatin). In some embodiments, the target drug is 5-FU and the biomarker is selected from the biomarkers of Table 1 or 2. In alternate embodiments, the target drug is irinotecan and the biomarker is selected from the biomarkers of Table 3 or 4. In other embodiments, the target drug is oxaliplatin and the biomarker is selected from the biomarkers of Table 5 or 6.

Kits

Kits of the present invention can be used for diagnosing the responsiveness of a subject to a treatment for cancer (e.g., 5-FU, irinotecan, or oxaliplatin, or an analog thereof) and/or for treating the subject for cancer. Kits of the invention can include reagents and/or materials for, e.g., collecting and/or purifying nucleic acids from biological samples (such as those obtained from a subject to be treated with a target drug of the invention), reagents for amplifying such nucleic acids to produce an amplified sample, and/or at least one device of the invention as described herein. Reagents for amplifying nucleic acids may include, e.g., PCR reagents, including but not limited to DNA polymerase, RNA polymerase, PCR buffer, magnesium chloride solutions, nucleic acid primers (e.g., primers designed to target particular biomarkers of responsiveness to a target drug of interest), and/or any other PCR reagents as are well known in the art. In some embodiments, a kit of the invention includes one or more probes capable of detecting one or more biomarkers of responsiveness to a target drug of interest. Such probes can, for example, include nucleic acids capable of hybridizing to the biomarker based on nucleic acid sequence complementarity. In certain embodiments, a probe has at least 85% sequence identity (e.g., 85%, 90%, 95%, 97%, 98%, 99%, or 100% sequence identity) to a nucleic acid sequence that is complementary or identical to at least 5 (e.g., at least 15) consecutive nucleotides of one or more biomarkers. The probes can be attached a solid surface, such as a microarray. In certain embodiments, the kit includes NanoString capture probes, NanoString reporter probes, and/or one or more nCounter cartridges. In certain embodiments, the kit includes reagents for next generation sequencing, including but not limited to poly(T) oligonucleotides, dye terminators, sequencing adapters, adapter ligation reagents, reverse transcriptase, primers (e.g., random primers), DNA-cleaving enzymes, polymerases, and/or any combination thereof. In alternate embodiments, the kit includes a protein array and/or reagents for detection of the polypeptide gene products of one or more biomarkers of responsiveness, such as those described herein.

The invention further includes kits for administering one or more target drugs, including but not limited to 5-FU, irinotecan, and oxaliplatin, as well as analogs thereof, such as prodrugs, derivatives, metabolites, enantiomers, and combinations thereof. For example, 5-FU prodrugs that can be included in kits of the invention include capecitabine and tegafur. Such kits may contain a composition or formulation of the target drug in question, or an enantiomer, prodrug, metabolite, or pharmaceutically acceptable salt thereof, together with the customary items for administering the therapeutic ingredient as are known in the art. In certain embodiments, a kit for administering a target drug may further include any of the reagents, materials, kits, or devices described above.

The following examples are intended to illustrate, rather than limit, the invention.

EXAMPLES

Example 1

Predicting Drug Responsiveness to 5-FU in Various Cancer Patient Populations

An mRNA-based predictor of responsiveness to 5-FU developed according to the methods of the invention was applied to 3522 patients having a variety of cancers, from each of whom we have a pre-treatment measurement of gene expression with an Affymetrix array of either type U133A or U133Plus2. When the patients were grouped by indication (e.g., a particular cancer exhibited by the patient), it was possible to compare the indications and identify particular cancer types predicted to be more sensitive to 5-FU (FIG. 1). In an analysis of 27 different cancer indications, it was predicted that chronic myelogenous leukemia—chronic phase, acute lymphoblastic leukemia, colon cancer, hepatocellular carcinoma, and multiple myeloma were most sensitive to 5-FU. In a similar analysis of 62 cancer drugs approved by the FDA, the indication for which 5-FU treatment was approved by the FDA was (in 13 cases) predicted by our drug response predictor as "most sensitive" to 5-FU treatment (out of the 28 indications examined in our preclinical analysis). In 33 cases, the indication approved was among the top five predictions. This indicates that our pre-clinical prediction of indication sensitivity can successfully predict the indication that is later approved by the FDA. Also, in prior analyses of drugs tested in such studies, we have found that a difference in predicted sensitivity translated to a difference in clinical response rate. Table 13 ranks all 27 indications according to their predicted mean sensitivity to 5-FU.

TABLE 13

27 indications ordered by rank of their mean predicted sensitivity to 5-fluorouracil. The reference cites the publication of the trial from which the samples were obtained.

| Rank | Abbrev. | Full name | Reference |
|---|---|---|---|
| 1 | CMLCP | Chronic myelogenous leukemia - cronic phase | Bruennert |
| 2 | ALL | Acute lympho-blastic leukemia | Ross (2003); Holleman |
| 3 | Colon | Colon Cancer | Smith; Khambata-Ford |
| 4 | HCC | Hepatocellular Carcinoma | Liao |
| 5 | MM | Multiple Myeloma | Agnelli |
| 6 | AML | Acute myelogenous leukemia | Metzeler; Lubbert; Ross (2004) |
| 7 | DLBCL | Diffuse Large B cell lymphoma | Hummel; Lenz |
| 8 | eso | Esophageal cancer | Kimchi |
| 9 | MDS | Myelodysplastic syndrome | Mills |
| 10 | CLL | Chronic lymphocytic leukemia | Ouilette |
| 11 | ERpos | ERpos breast cancer | Hess |
| 12 | PTCL | Peripheral T-cell lymphoma | Piccaluga |
| 13 | Breast | Breast cancer | Hess; Zhang |
| 14 | ovary | Ovarian Cancer | Bild; Denkert |
| 15 | Bladder | Bladder Cancer | Dyrksjot |
| 16 | RCC | Renal Cell Carcinoma | Lenburg |
| 17 | Hodgkin | Hodgkin's lymphoma | VanLoo; Steidl; Chetaille |
| 18 | Cervix | Cervical cancer | Scotto |
| 19 | pancreas | Pancreatic cancer | Gautier |
| 20 | NSCLC | Non small cell lung cancer | Bild |
| 21 | Prosta | Prostate cancer | Wanf |
| 22 | CTCL | Cutaneous T-Cell lymphoma | Shin |
| 23 | Melan | Melanoma | Xu |
| 24 | SCCHN | Squamous Cell Carcinoma of the Head and Neck | Slebos |
| 25 | glioma | Glioma | Freije |
| 26 | GIST | Gastrointestinal Stromal Tumor | Yamaguchi; Ostrowski; Astolfi |
| 27 | Sarcom | Sarcoma | Barretina |

Subgroup Analysis in Non-Small Cell Lung Cancer (NSCLC)

Figure 2:
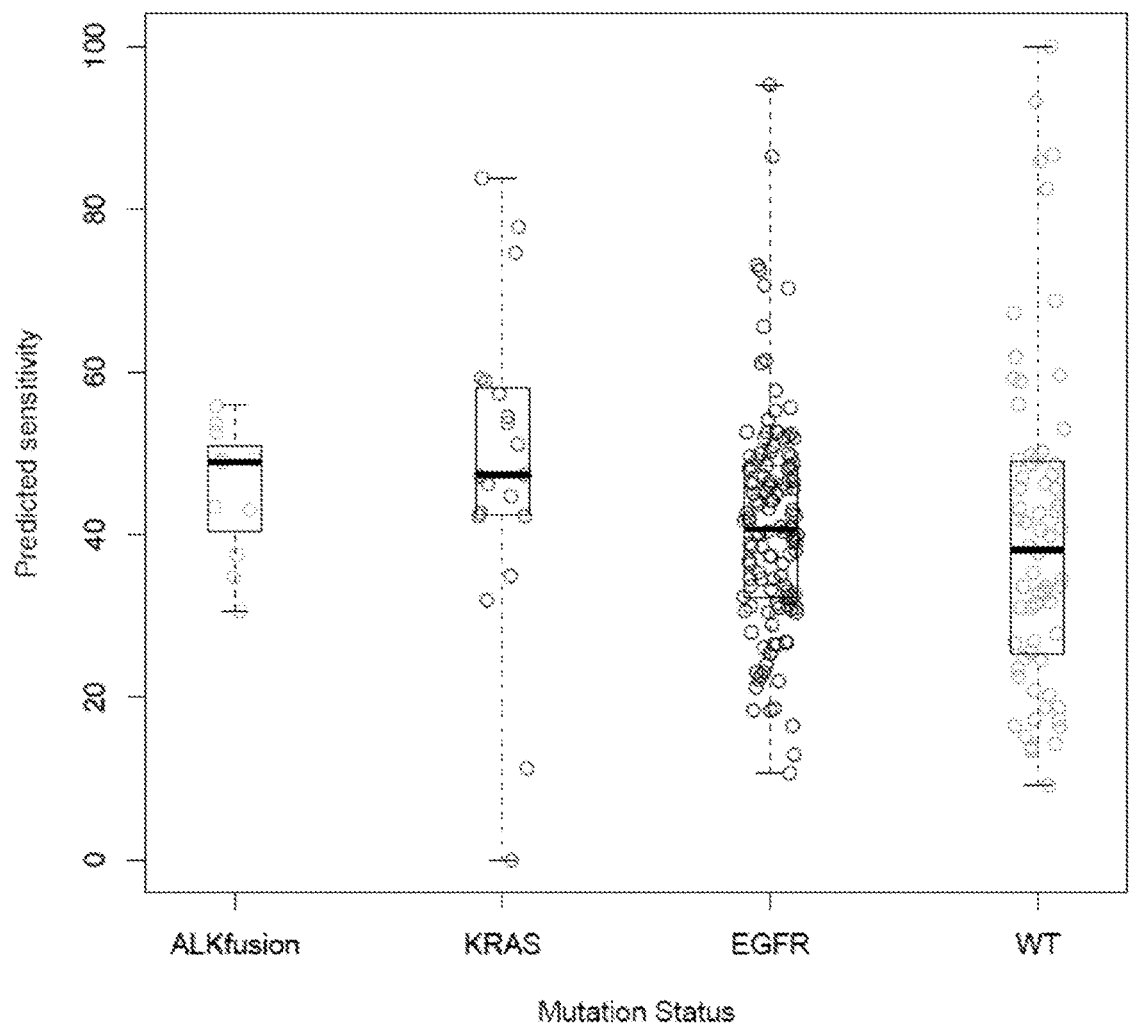
FIG. 2 is a graph showing predicted sensitivity to 5-FU in 226 Japanese non-small cell lung cancer (NSCLC) adenocarcinomas according to mutation status. Boxes represent first and third quartiles, and whiskers indicate minimum and maximum values. The dark line indicates the median value.

The predicted sensitivity to 5-FU was compared among different subgroups of NSCLC. A dataset of 226 primary adenocarcinomas with corresponding mutation statuses was obtained from Japan (see PMID: 22080568). FIG. 2 shows the predicted sensitivity to 5-FU for each sample, according to mutation status. A Wilcoxon rank test was run to compare the three mutation subgroups to wild type: EGFR P-value: 0.27, KRAS P-value: 0.032, ALK fusion P-value: 0.091.

Subgroup Analysis in Breast Cancer

Figure 3:
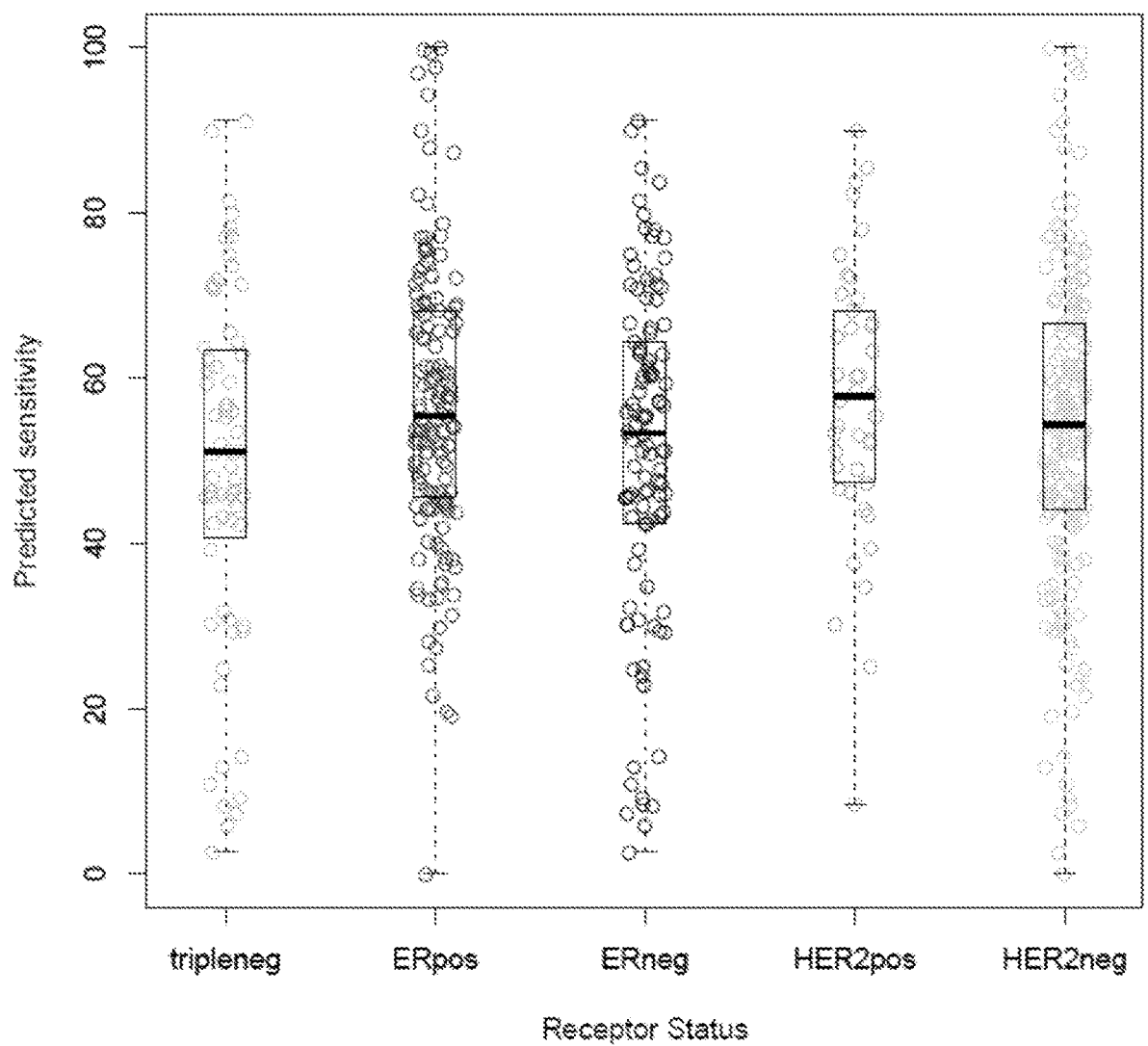
FIG. 3 is a graph showing predicted sensitivity to 5-FU in 243 breast cancer patients according to receptor status. Boxes represent first and third quartiles, and whiskers indicate minimum and maximum values. The dark line indicates the median value.

The predicted sensitivity to 5-FU was compared among different subgroups of breast cancer. A dataset of 243 breast cancer specimens was obtained (Hess, 2006). FIG. 3 shows the predicted sensitivity to 5-FU for each specimen, according to ER, HER2, and PR status. A Wilcoxon rank test was run to compare the three receptor subtypes to their wild type counterpart: ERpos versus ERneg P-value: 0.11, PRpos versus PRneg P-value: 0.8, HER2pos versus HER2neg P-value: 0.24, triple negative versus not triple negative P-value: 0.048.

Drug Combinations

The strategy behind drug combination therapy is to exploit multiple targets in, e.g., anticancer treatment and thereby increase response. As drug similarity is revealed according to the present invention, it can be used for selecting drugs for combination therapy by selecting drugs that show little similarity. Here, the predictor of response to 5-FU was compared to other drug response predictors in order to identify candidates for combination treatment. If a patient predicted to be responsive to 5-FU was likewise predicted to be responsive to a given combination drug candidate, then that drug would be considered as a poor candidate, as in such a case, a trial comparing the drug with or without combination with 5-FU would be predicted to provide little difference between the two arms. Conversely, it is predicted that a trial comparing a good combination candidate (e.g., a drug having different predictors of responsiveness from 5-FU) with or without 5-FU will give greater response rate in the 5-FU arm, because patients that fail therapy with the good combination candidate are likely to respond to 5-FU.

The analysis has to be performed on specific patients with a specific disease. It is not certain that the pattern would be the same if another disease is chosen. We decided to use 243 breast cancer specimens from a published cohort (Hess, 2006). If other indications are to be considered, it is possible to repeat the analysis in a different indication and see if the results change. Candidate drugs were selected according to the following criteria: (1) FDA approved, (2) NCI60 growth inhibition data available, with more than 2 sensitive cell lines, (3) in vitro correlation between prediction and cell line test set greater than 0.15. A total of 52 anticancer drugs met these criteria, and response predictors were thus developed for these drugs using the same procedure as was used for the 5-FU predictor. The Pearson correlation between the predicted sensitivity to the drug and to 5-FU was calculated using the 243 breast cancer patients. The most promising candidate drugs would have a negative CC, meaning that their predicted sensitivity in breast cancer is negatively correlated with sensitivity to 5-FU. The 95% confidence interval was calculated based on the 243 patients.

TABLE 14

Candidate combination drugs sorted according to Pearson correlation to 5-FU in breast cancer.

| Rank | Drug | Pearson CC | 95% C.I. |
|---|---|---|---|
| 1 | Afinitor (everolimus) | −0.74 | −0.79 −0.674 |
| 2 | Temsirolimus (Torisel) | −0.63 | −0.703 −0.552 |
| 3 | Bleomycin | −0.55 | −0.628 −0.45 |
| 4 | Lomustine | −0.46 | −0.555 −0.356 |
| 5 | Depsipeptide (ISTODAX) | −0.42 | −0.516 −0.307 |
| 6 | Carboplatin | −0.35 | −0.457 −0.236 |
| 7 | Bortezomib | −0.32 | −0.431 −0.205 |
| 8 | Erlotinib (tarceva) | −0.32 | −0.426 −0.199 |
| 9 | Gemcitabine (Gemzar) | −0.32 | −0.424 −0.197 |
| 10 | Gemcitabine (Gemzar) | −0.32 | −0.424 −0.197 |
| 11 | Mitoxantrone | −0.31 | −0.423 −0.196 |
| 12 | Cisplatin | −0.2 | −0.317 −0.0748 |
| 13 | Busulfan | −0.16 | −0.277 −0.0317 |
| 14 | Epirubicin (epiadriamycin) | −0.16 | −0.276 −0.0301 |
| 15 | Arsenic trioxide (Trisenox) | −0.15 | −0.27 −0.0238 |
| 16 | bendamustine (Treanda) | −0.14 | −0.261 −0.0141 |
| 17 | Irinotecan | −0.14 | −0.257 −0.0104 |
| 18 | Vincristine | −0.12 | −0.241 0.00706 |
| 19 | Fulvestrant | −0.098 | −0.222 0.0277 |
| 20 | Teniposide | −0.096 | −0.219 0.0306 |
| 21 | Adriamycin | −0.091 | −0.215 0.0349 |
| 22 | 5-Aza-2'-deoxycytidine (decitabine) | −0.037 | −0.163 0.0888 |
| 23 | Estramustine | −0.0074 | −0.133 0.119 |
| 24 | Leukeran (Chlorambucil) | 0.0033 | −0.123 0.129 |
| 25 | Melphalan | 0.006 | −0.12 0.132 |
| 26 | Hydroxyurea | 0.014 | −0.112 0.14 |
| 27 | Ixabepilone (Ixempra) | 0.018 | −0.108 0.143 |
| 28 | Procarbazine (Matulane) | 0.032 | −0.094 0.157 |
| 29 | Sorafenib (Nexavar) | 0.033 | −0.093 0.158 |
| 30 | Thiotepa (Thioplex) | 0.045 | −0.0813 0.17 |
| 31 | Vinblastine (velban) | 0.045 | −0.0812 0.17 |
| 32 | Daunorubicin | 0.048 | −0.0781 0.173 |
| 33 | Vinorelbine (Navelbine) | 0.049 | −0.0776 0.174 |
| 34 | Dacarbazine | 0.053 | −0.0738 0.177 |
| 35 | Valrubicin (Valstar) | 0.064 | −0.0626 0.188 |
| 36 | Carmustine | 0.083 | −0.0432 0.207 |
| 37 | Exemestane | 0.11 | −0.0172 0.232 |
| 38 | Tamoxifen | 0.15 | 0.022 0.268 |
| 39 | Eribulin | 0.18 | 0.0519 0.296 |
| 40 | Fludarabine | 0.18 | 0.0541 0.298 |
| 41 | Iressa | 0.2 | 0.0815 0.323 |
| 42 | Ara-C (Cytarabine hydrochloride) | 0.25 | 0.13 0.366 |
| 43 | Mechlorethamine | 0.26 | 0.134 0.37 |
| 44 | Idarubicin | 0.29 | 0.173 0.404 |
| 45 | Gleevec (Imatinib) | 0.36 | 0.247 0.466 |
| 46 | Lapatinib (Tykerb) | 0.38 | 0.269 0.484 |
| 47 | Taxotere (docetaxel) | 0.41 | 0.303 0.512 |
| 48 | Asparaginase (Elspar) | 0.44 | 0.332 0.536 |
| 49 | Thioguanine | 0.45 | 0.348 0.548 |
| 50 | Clofarabine (Clolar) | 0.48 | 0.372 0.567 |
| 51 | Nilotinib (Tasigna) | 0.48 | 0.374 0.569 |
| 52 | Mercaptopurine | 0.5 | 0.398 0.588 |
| 53 | Vorinostat (SAHA) | 0.66 | 0.576 0.721 |
| 54 | Paclitaxel (Taxol) | 0.69 | 0.616 0.749 |
| 55 | Oxaliplatin | 0.72 | 0.654 0.776 |
| 56 | Pralatrexate (Folotyn) | 0.72 | 0.658 0.779 |
| 57 | Methotrexate | 0.85 | 0.811 0.882 |
| 58 | 5-Fluorouracil (5-FU) | 0.99 | 0.992 0.995 |

95% C.I. = 95% confidence interval.
CC = correlation coefficient.

Figure 4:
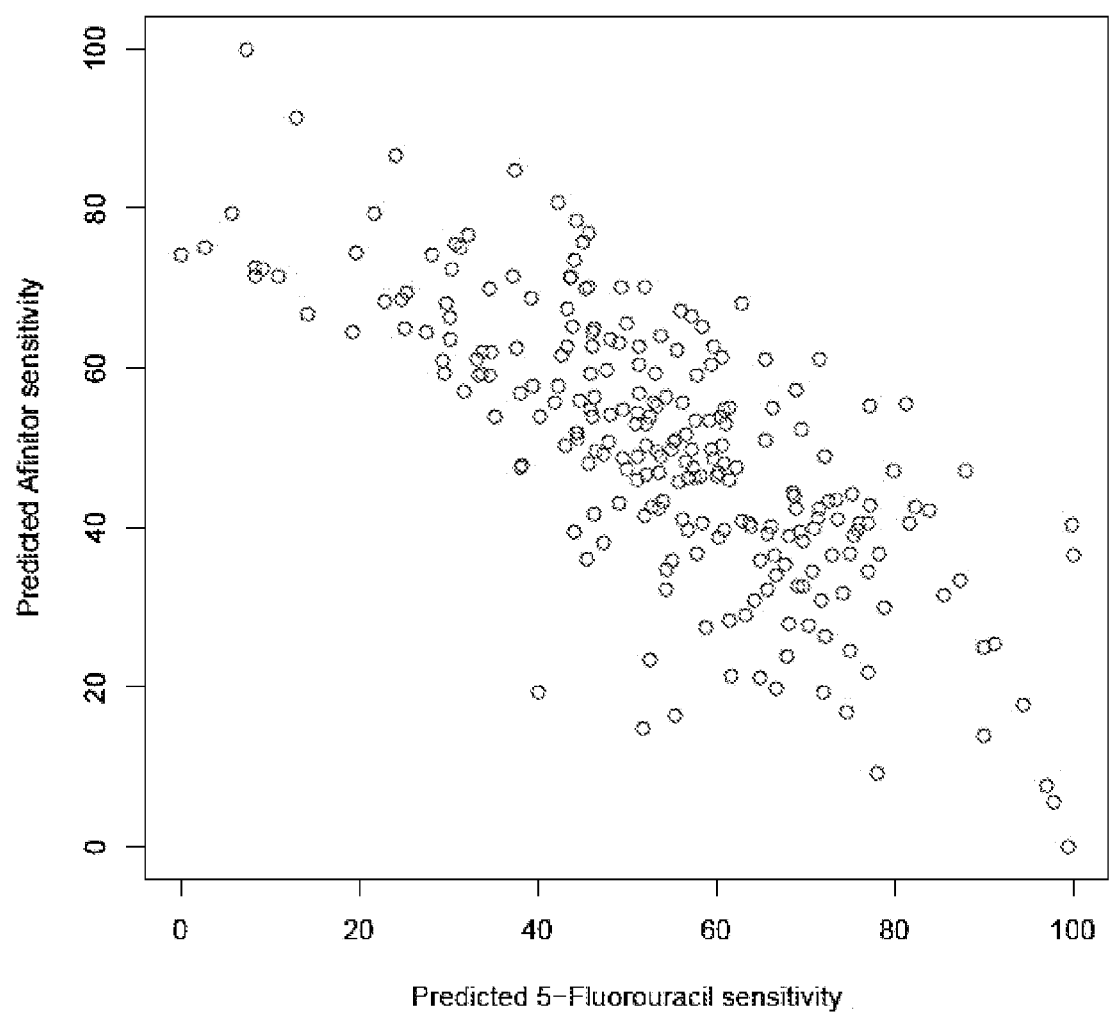
FIG. 4 is a graph comparing predicted sensitivity to 5-FU and Afinitor (everolimus) in 243 breast cancer patients.

The drugs Afinitor (everolimus), Temsirolimus (Torisel), Bleomycin, and Lomustine were predicted to be good candidates for combination therapy with 5-FU in breast cancer. FIG. 4 shows the predicted sensitivity of 243 breast cancer patients to 5-FU and to Afinitor (everolimus). For the drugs Vectibix and Bevacizumab, NCI60 in vitro data was absent. For the drugs Cetuximab and Xeloda, NCI60 data was of poor quality or inconclusive. The drugs Pemetrexed, Temozolomide, Mitomycin, Topotecan, Streptozocin, Herceptin, Anastrozole and Letrozole failed in our internal quality criteria.

Example 2

Predicting Survival in Colon Cancer Patients Treated with 5-FU

Figure 5:
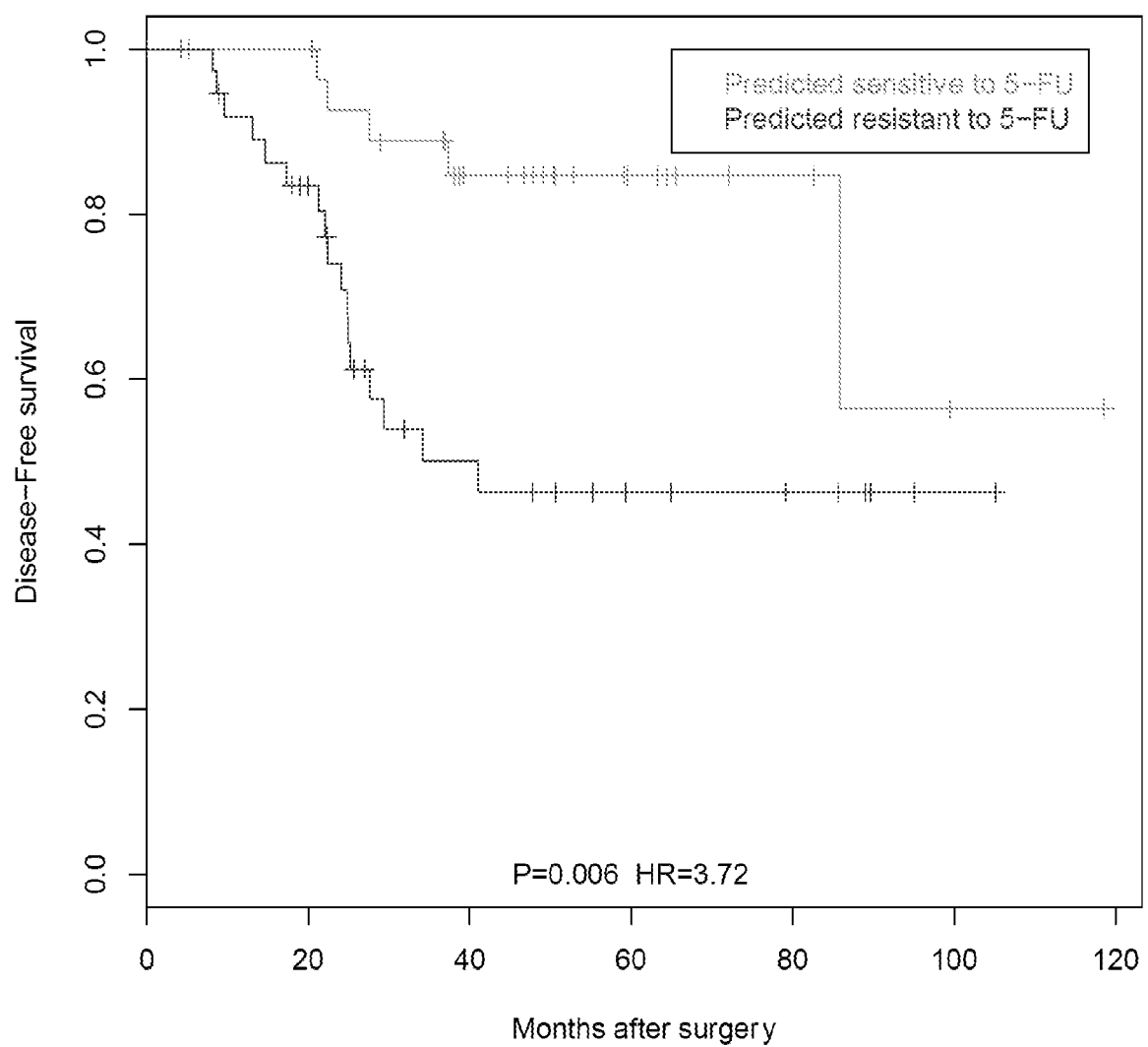
FIG. 5 is a graph showing disease-free survival of patients predicted sensitive to 5-FU (gray) and patients predicted resistant to 5-FU (black). HR=hazard ratio.

A clinical dataset of 232 pre-treatment fresh frozen colorectal cancer surgical biopsies was downloaded from Gene Expression Omnibus under accession number GSE17538. The biopsies were analyzed using the Affymetrix HG-U133-Plus_2 array type. The expression of NT5E was determined by reading the intensity of Affymetrix probeset 203939_at, which is predicted to be more highly expressed in 5-FU-resistant patients. Patients were predicted sensitive to 5-FU if the expression of NT5E was below the population median. Patients were predicted resistant if expression of NT5E was above the population median. As shown in FIG. 5, there was a statistically significant difference in survival between the predicted-sensitive group and the predicted-resistant group after months of adjuvant chemotherapy with 5-FU, with the predicted-sensitive group showing a significantly higher rate of survival than the predicted-resistant group (p=0.006).

If using more genes from Tables 1 and 2 than NT5E to predict sensitivity, the prediction can be performed as follows:

Prediction=mean(genes from Table 1)−mean(genes from Table 2)

Example 3

Predicting FOLFIRI Treatment Response in Colon Cancer Patients

A dataset of 40 formalin-fixed paraffin embedded (FFPE) colorectal cancer patient biopsies analyzed on the Almac Colorectal Cancer DSATM array type was downloaded from ArrayExpress under accession number E-MEXP-3549. The advantage of the Almac array compared to the HG-U133_Plus_2 array used in Example 2 is that the Almac array can use FFPE samples instead of fresh frozen samples. Fresh frozen samples are not routinely stored in surgical or pathological practice, but storing FFPE samples is standard procedure, and has been done for more than 100 years. Thus, the Almac array is logistically easier to incorporate into existing clinical practice than the HG-U133_Plus_2 array. All patients were treated with 5-FU and irinotecan (FOLFIRI).

The NT5E gene for 5-FU resistance was mapped to corresponding Almac probesets ADXCRAG_NM_002526_at (SEQ ID NO: 1015), ADXCRAG_NM_002526_s_at (SEQ ID NO: 1016), ADXCRPD.5241.C1_at (SEQ ID NO: 1683), ADXCRSS.Hs # S1299958_at (SEQ ID NO: 2064), ADXCRSS.Hs #53735513_at (SEQ ID NO: 2207), ADXCRAD_BX404438_s_at (SEQ ID NO: 2316), ADXCRAD_BM704188_at (SEQ ID NO: 2446), ADXCRAD_BG611920_at (SEQ ID NO: 2714), ADXCRAD_BC015940_at (SEQ ID NO: 2778) by using the file A-AFFY-101.adf.txt associated with the Almac array.

The PRF1 gene for irinotecan sensitivity was mapped to corresponding Almac probesets ADXCRAD_BQ654088_at (SEQ ID NO: 2314), ADXCRAD_BQ654088_x_at (SEQ ID NO: 2315), ADXCRAD_A1445650_at (SEQ ID NO: 2881).

Figure 6:
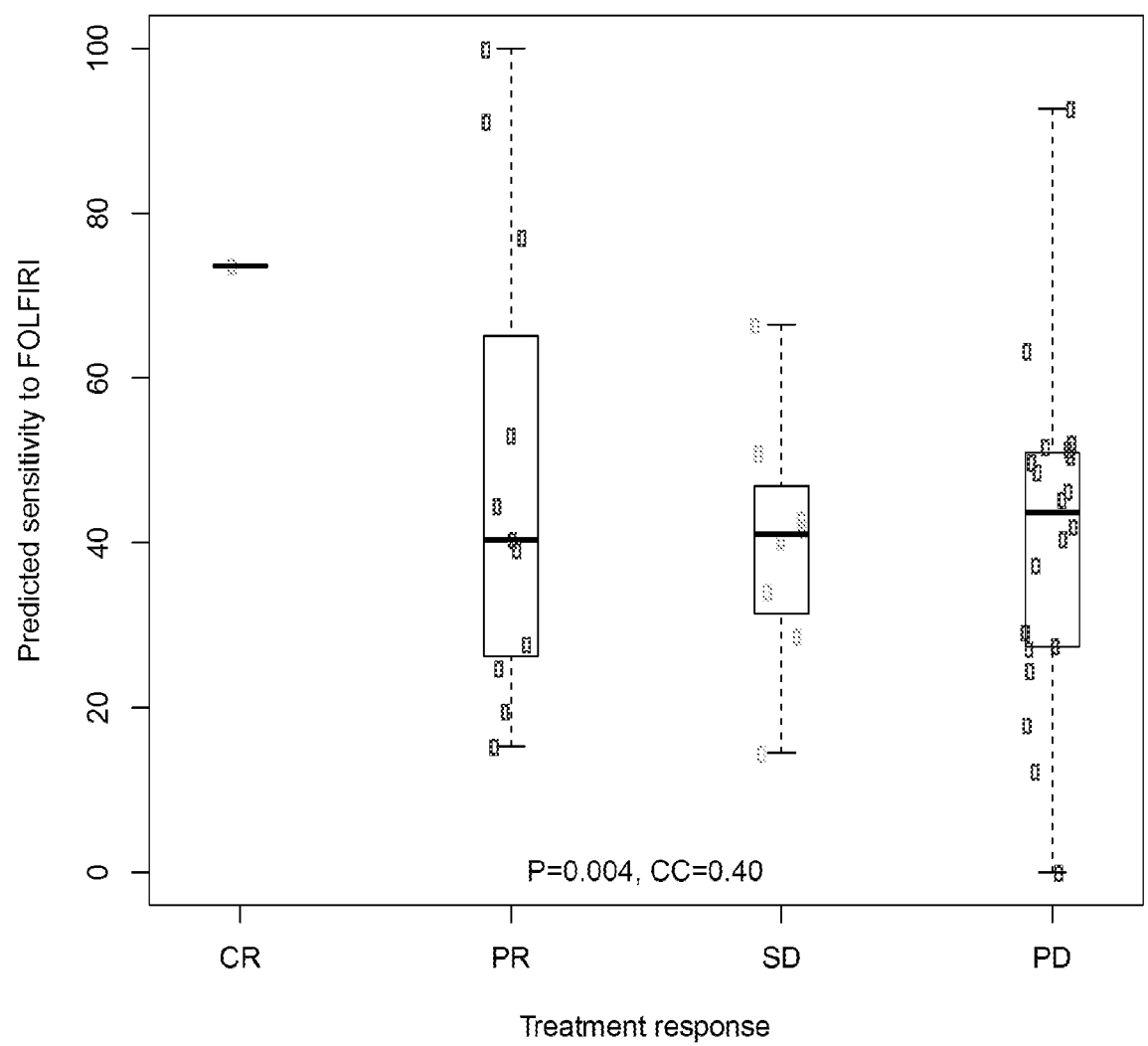
FIG. 6 is a graph showing the predicted sensitivity of colorectal cancer patients to FOLFIRI. CR=complete responders, PR=partial responders, SD=stable disease, PD=progressive disease, CC=correlation coefficient. Boxes represent first and third quartiles, and whiskers indicate minimum and maximum values. The dark line indicates the median value.

FIG. 6 shows the predicted sensitivity to FOLFIRI based on the expression of the Almac probesets, based on the following algorithm:

Prediction=mean(PRF1 Almac probesets)−mean(NT5E Almac probesets)

normalized to a scale of 0 to 100 in the patients, when grouped according to clinical response to adjuvant chemotherapy with 5-FU and irinotecan. The population median was used as a cutoff between sensitive and resistant patients. The correlation between clinical response (CR=4,PR=2, SD=2,PD=1) and predicted sensitivity was evaluated with a Pearson correlation and gave a one-sided p-value of 0.004 and a correlation coefficient (CC) of 0.40.

If using more genes from Tables 1, 2, 3 and 4 to predict sensitivity, the genes can be mapped to the matching Almac probesets by lookup in file A-AFFY-101.adf.txt associated with the Almac array and available from ArrayExpress at http://www.ebi.ac.uk/arrayexpress/files/A-AFFY-101/A-AFFY-101.adf.txt. The prediction is then performed as follows:

Prediction=mean(probesets matching Table 1/3)−mean(probesets matching Table 2/4)

Example 4

Predicting FOLFOX Treatment Response in Colon Cancer Patients

A clinical dataset of 17 pre-treatment fresh frozen colorectal cancer surgical biopsies was downloaded from Gene Expression Omnibus under accession number GSE19860. The biopsies have been analyzed using the Affymetrix HG-U133-Plus_2 array type. All patients were treated adjuvantly with mFOLFOX6 (5-FU and oxaliplatin). The expression of NT5E was determined by reading the intensity of Affymetrix probeset 203939_at that is predicted higher expressed in 5-FU resistant patients. The expression of MRPL16 was determined by reading the intensity of Affymetrix probeset 217980_s_at that is predicted to be higher expressed in oxaliplatin sensitive patients.

Figure 7:
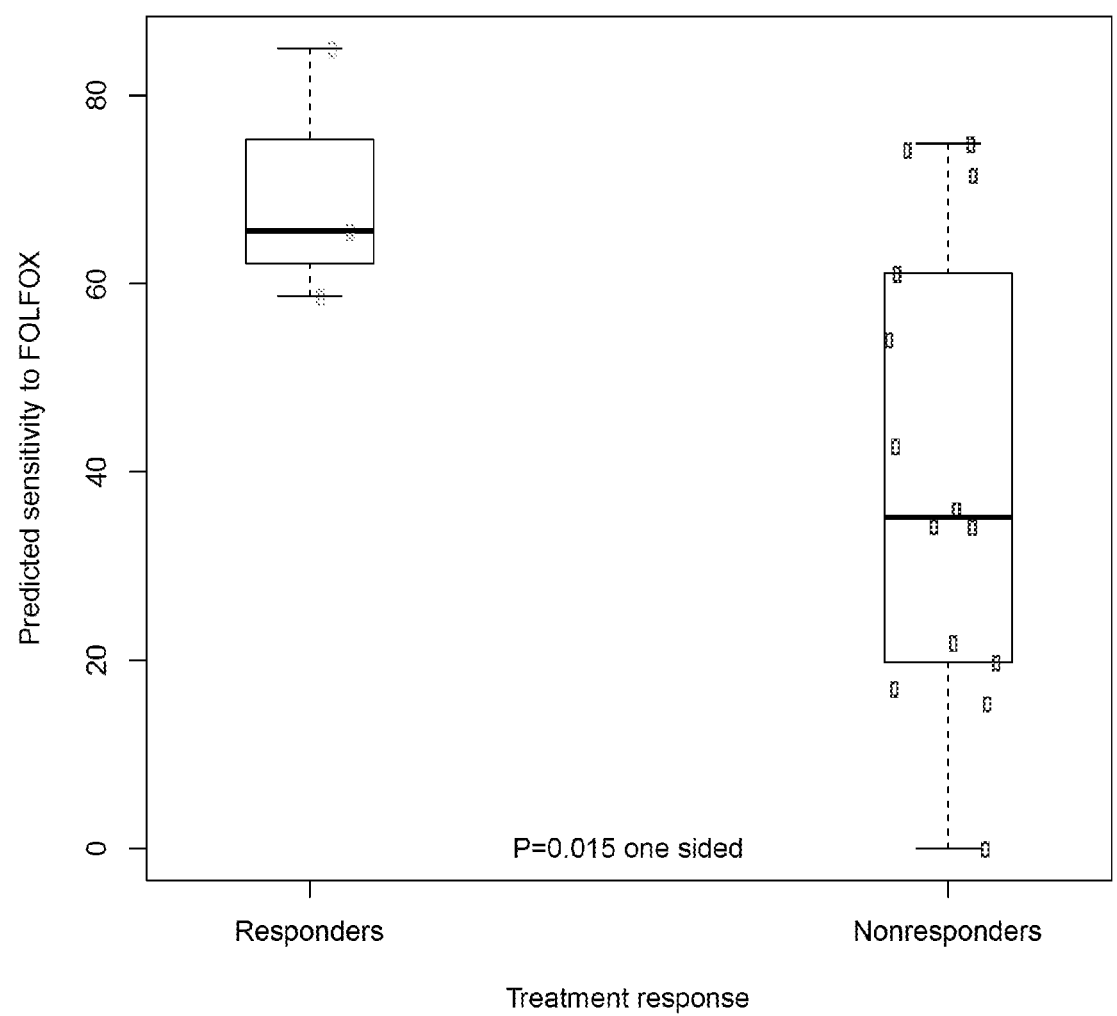
FIG. 7 is a graph showing the predicted sensitivity of colorectal cancer patients (responders and non-responders) to FOLFOX. Boxes represent first and third quartiles, and whiskers indicate minimum and maximum values. The dark line indicates the median value.

FIG. 7 shows the predicted sensitivity to FOLFOX based on the following algorithm:

Prediction=217980_s_at−203939_s_at normalized to a scale of 0 to 100 in the patients when grouped according to clinical response to adjuvant chemotherapy with FOLFOX. The population median was used as a cutoff between sensitive and resistant patients. A t-test of difference in predicted sensitivity between responders and non-responders gave a statistically significant one-sided p-value of 0.015.

Example 5

Predicting 5-FU Treatment Responsiveness and Adjusting Subsequent Treatment

The diagnostic methods of the present invention can be used to predict the responsiveness of a subject (e.g., a subject suffering from or susceptible to colon cancer or breast cancer) to treatment with 5-FU or a prodrug for 5-FU, such as capecitabine or tegafur. A biological sample (e.g., a tumor biopsy) may be obtained from the subject through methods well known in the art. The sample may be frozen and/or prepared, e.g., by formalin fixation and paraffin embedding. mRNA can be isolated from the sample and a gene expression profile determined, e.g., using a microarray platform such as the Almac Colorectal Cancer DSATM array or the Affymetrix HG-U133-Plus_2 array. Alternatively, specific biomarkers of resistance and/or sensitivity to 5-FU can be measured, e.g., by microarray, sequencing, or PCR-based techniques, such as those described herein. For example, the expression levels of the 5-FU resistance biomarkers NT5E, CNN3, ACTN1, FLNA, and/or ATP2B4 can be determined. The expression levels of the 5-FU sensitivity biomarkers APRT, GSR, TUFM, MRPS2, and/or MTHFD2 can also be determined. An elevated level of one or more of the biomarkers of resistance and/or sensitivity can indicate the responsiveness of the subject to treatment with 5-FU. For example, an elevated level of one or more 5-FU resistance biomarkers in the subject, relative to a control (e.g., the population median) can indicate that the subject is resistant to 5-FU treatment. Alternatively, for example, an elevated level of one or more 5-FU sensitivity biomarkers in the subject, relative to a control (e.g., the population median) can indicate that the subject is sensitive to 5-FU treatment. Furthermore, the relative expression levels of 5-FU resistance and sensitivity biomarkers can indicate the responsiveness of the subject to 5-FU treatment.

If a subject is predicted to be sensitive to 5-FU treatment, then subsequent treatment of the subject can be altered, e.g., to include 5-FU and/or a prodrug thereof (e.g., capecitabine or tegafur), or to decrease dosage, frequency of administration, and/or length of treatment with 5-FU and/or a prodrug thereof (e.g., capecitabine or tegafur). Conversely, if a subject is predicted to be resistant to 5-FU treatment, then subsequent treatment of the subject can be altered, e.g., to omit 5-FU and/or a prodrug thereof (e.g., capecitabine or tegafur), or to increase dosage, frequency of administration, and/or length of treatment with 5-FU and/or a prodrug thereof (e.g., capecitabine or tegafur). Furthermore, a subject predicted to be resistant to 5-FU can be administered drugs other than 5-FU, such as irinotecan, oxaliplatin, and/or another chemotherapeutic agent as described herein.

Example 6

Predicting Irinotecan Treatment Responsiveness and Adjusting Subsequent Treatment The diagnostic methods of the present invention can be used to predict the responsiveness of a subject (e.g., a subject suffering from or susceptible to colon cancer or breast cancer) to treatment with irinotecan. A biological sample (e.g., a tumor biopsy) may be obtained from the subject through methods well known in the art. The sample may be frozen and/or prepared, e.g., by formalin fixation and paraffin embedding. mRNA can be isolated from the sample and a gene expression profile determined, e.g., using a microarray platform such as the Almac Colorectal Cancer DSATM array or the Affymetrix HG-U133-Plus_2 array. Alternatively, specific biomarkers of resistance and/or sensitivity to irinotecan can be measured, e.g., by microarray, sequencing, or PCR-based techniques, such as those described herein. For example, the expression levels of the irinotecan sensitivity biomarkers PRF1, GZMB, PTPRC, PTPRC, and/or PTPRCAP can be determined. The expression levels of the irinotecan resistance biomarkers CCND1, LGALS3, INPP4B, TMEM97, and/or TCF7L2 can also be determined. An elevated level of one or more of the biomarkers of resistance and/or sensitivity can indicate the responsiveness of the subject to treatment with irinotecan. For example, an elevated level of one or more irinotecan resistance biomarkers in the subject, relative to a control (e.g., the population median) can indicate that the subject is resistant to irinotecan treatment. Alternatively, for example, an elevated level of one or more irinotecan sensitivity biomarkers in the subject, relative to a control (e.g., the population median) can indicate that the subject is sensitive to irinotecan treatment. Furthermore, the relative expression levels of irinotecan resistance and sensitivity biomarkers can indicate the responsiveness of the subject to irinotecan treatment.

If a subject is predicted to be sensitive to irinotecan treatment, then subsequent treatment of the subject can be altered, e.g., to include irinotecan or to decrease dosage, frequency of administration, and/or length of treatment with irinotecan. Conversely, if a subject is predicted to be resistant to irinotecan treatment, then subsequent treatment of the subject can be altered, e.g., to omit irinotecan or to increase dosage, frequency of administration, and/or length of treatment with irinotecan. Furthermore, a subject predicted to be resistant to irinotecan can be administered drugs other than irinotecan, such as 5-FU, capecitabine, tegafur, oxaliplatin, and/or another chemotherapeutic agent as described herein.

Example 7

Predicting Oxaliplatin Treatment Responsiveness and Adjusting Subsequent Treatment The diagnostic methods of the present invention can be used to predict the responsiveness of a subject (e.g., a subject suffering from or susceptible to colon cancer or breast cancer) to treatment with oxaliplatin. A biological sample (e.g., a tumor biopsy) may be obtained from the subject through methods well known in the art. The sample may be frozen and/or prepared, e.g., by formalin fixation and paraffin embedding. mRNA can be isolated from the sample and a gene expression profile determined, e.g., using a microarray platform such as the Almac Colorectal Cancer DSATM array or the Affymetrix HG-U133-Plus_2 array. Alternatively, specific biomarkers of resistance and/or sensitivity to oxaliplatin can be measured, e.g., by microarray, sequencing, or PCR-based techniques, such as those described herein. For example, the expression levels of the oxaliplatin sensitivity biomarkers MRPL16, ANP32A, SRSF2, PDSS1, and/or PRIM1 can be determined. The expression levels of the oxaliplatin resistance biomarkers LPP, RHOC, CAPN2, FLNA, and/or WDR1 can also be determined. An elevated level of one or more of the biomarkers of resistance and/or sensitivity can indicate the responsiveness of the subject to treatment with oxaliplatin. For example, an elevated level of one or more oxaliplatin resistance biomarkers in the subject, relative to a control (e.g., the population median) can indicate that the subject is resistant to oxaliplatin treatment. Alternatively, for example, an elevated level of one or more oxaliplatin sensitivity biomarkers in the subject, relative to a control (e.g., the population median) can indicate that the subject is sensitive to oxaliplatin treatment. Furthermore, the relative expression levels of oxaliplatin resistance and sensitivity biomarkers can indicate the responsiveness of the subject to oxaliplatin treatment.

If a subject is predicted to be sensitive to oxaliplatin treatment, then subsequent treatment of the subject can be altered, e.g., to include oxaliplatin or to decrease dosage, frequency of administration, and/or length of treatment with oxaliplatin. Conversely, if a subject is predicted to be resistant to oxaliplatin treatment, then subsequent treatment of the subject can be altered, e.g., to omit oxaliplatin or to increase dosage, frequency of administration, and/or length of treatment with oxaliplatin. Furthermore, a subject predicted to be resistant to oxaliplatin can be administered drugs other than oxaliplatin, such as 5-FU, capecitabine, tegafur, irinotecan, and/or another chemotherapeutic agent as described herein.

OTHER EMBODIMENTS

All publications, patents, and patent applications mentioned in the above specification are hereby incorporated by reference to the same extent as if each individual publication, patent or patent application was specifically and individually indicated to be incorporated by reference in its entirety. Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (2902 sequences)

SEQ ID NO: 1 - DNA, 25 bp, Homo sapiens
ctctcctgcagtatgagtgaccaca

SEQ ID NO: 2 - DNA, 25 bp, Homo sapiens
gcaatagctgctggccgaaaacttg

SEQ ID NO: 3 - DNA, 25 bp, Homo sapiens
gaacatggcctgtcggattatcctg

SEQ ID NO: 4 - DNA, 25 bp, Homo sapiens
gttacttactcagctgatgtcacag

SEQ ID NO: 5 - DNA, 25 bp, Homo sapiens
gctgtccttttgaggcttagtcagt

SEQ ID NO: 6 - DNA, 25 bp, Homo sapiens
aagtgccggtgacaagctgtctgtc

SEQ ID NO: 7 - DNA, 25 bp, Homo sapiens
gactgctcatggattttgtagctgt

SEQ ID NO: 8 - DNA, 25 bp, Homo sapiens
aggaaacggttcatgtgtcactttt

SEQ ID NO: 9 - DNA, 25 bp, Homo sapiens
ggacccgagagtcggccatcaatgt

SEQ ID NO: 10 - DNA, 25 bp, Homo sapiens
gaataaagtatcagaccctttggct

SEQ ID NO: 11 - DNA, 25 bp, Homo sapiens
tttggagttctcttacgtttcctgg

SEQ ID NO: 12 - DNA, 25 bp, Homo sapiens
gaatgactgcatggatagaaccact

SEQ ID NO: 13 - DNA, 25 bp, Homo sapiens
gtcaggaggcactgctcatctgtac

SEQ ID NO: 14 - protein, 25 aa, Homo sapiens
ACACACACCAGATGGCATCCTTGGG

SEQ ID NO: 15 - DNA, 25 bp, Homo sapiens
tgcgtgctcatccgaaagcggggga

SEQ ID NO: 16 - DNA, 25 bp, Homo sapiens
acagcaggcatcgcaactttctgca

SEQ ID NO: 17 - DNA, 25 bp, Homo sapiens
ggaccatgctgtatactccacagga

SEQ ID NO: 18 - DNA, 25 bp, Homo sapiens
gaagctctaagtacactcgtcttga

SEQ ID NO: 19 - DNA, 25 bp, Homo sapiens
ctactgaggcctttaagcaccgcta

SEQ ID NO: 20 - DNA, 25 bp, Homo sapiens
gtgagatcaaagctcctccaaagcc

SEQ ID NO: 21 - DNA, 25 bp, Homo sapiens
tactctggagcaacctactgtctaa

SEQ ID NO: 22 - DNA, 25 bp, Homo sapiens
catgtggggagaggaccagctgggt

SEQ ID NO: 23 - DNA, 25 bp, Homo sapiens
caaaggagaacatcctggcctgtcc

SEQ ID NO: 24 - DNA, 25 bp, Homo sapiens
gctaaaacggagcttttttgccctg

SEQ ID NO: 25 - DNA, 25 bp, Homo sapiens
tcaggccaggctcagtggctcatgc

SEQ ID NO: 26 - DNA, 25 bp, Homo sapiens
aatgagcaaatctccatactgtttc

SEQ ID NO: 27 - DNA, 25 bp, Homo sapiens
gacaaatatggaccctggctggagt

SEQ ID NO: 28 - DNA, 25 bp, Homo sapiens
gtcgctgttggatcgggttctaaag

SEQ ID NO: 29 - DNA, 25 bp, Homo sapiens
tttccccacaagctggcatttcagt

SEQ ID NO: 30 - DNA, 25 bp, Homo sapiens
gctggggaagtacgtcccagcggcc

SEQ ID NO: 31 - DNA, 25 bp, Homo sapiens
taaggcaggcagccaccgagtttgg

SEQ ID NO: 32 - DNA, 25 bp, Homo sapiens
cgctgtggcttggatcgcttcaagg

SEQ ID NO: 33 - DNA, 25 bp, Homo sapiens
cccagcaggccttttgttggttgca

SEQ ID NO: 34 - DNA, 25 bp, Homo sapiens
gtctggggctcatctaaactagttc

SEQ ID NO: 35 - DNA, 25 bp, Homo sapiens
gaactttcacacaagggtctgtaac

SEQ ID NO: 36 - DNA, 25 bp, Homo sapiens
gatgacttaccctgaagtcttccct

SEQ ID NO: 37 - DNA, 25 bp, Homo sapiens
atatattgggtcgtctgcttccctt

SEQ ID NO: 38 - DNA, 25 bp, Homo sapiens
ggaaggtgaatgtgttcccgtcctc

SEQ ID NO: 39 - DNA, 25 bp, Homo sapiens
gcgcctggcgatactggttgggggc

SEQ ID NO: 40 - DNA, 25 bp, Homo sapiens
ggtggtctttcaggttatcttggca

SEQ ID NO: 41 - DNA, 25 bp, Homo sapiens
aaccatcacctgttggccaacaagt

SEQ ID NO: 42 - DNA, 25 bp, Homo sapiens
cgacctgcggtcaaaactcacgagt

SEQ ID NO: 43 - DNA, 25 bp, Homo sapiens
aataaatatcatcctgccttcatgg

SEQ ID NO: 44 - DNA, 25 bp, Homo sapiens
aaccaatctgagccttgtatctctt

SEQ ID NO: 45 - DNA, 25 bp, Homo sapiens
tgacgatgagctgaccttcttgctg

SEQ ID NO: 46 - DNA, 25 bp, Homo sapiens
caagacttgggtaagctctgggcct

SEQ ID NO: 47 - DNA, 25 bp, Homo sapiens
taagaacaccgtggtcagggcctac

SEQ ID NO: 48 - DNA, 25 bp, Homo sapiens
gtaccctctatgactgtaattcctg

SEQ ID NO: 49 - DNA, 25 bp, Homo sapiens
ggtttggtgttttctatggtcctgt

SEQ ID NO: 50 - DNA, 25 bp, Homo sapiens
aatgccctttaactttctaatgatt

SEQ ID NO: 51 - DNA, 25 bp, Homo sapiens
gattggccagggctaccttatcaag

SEQ ID NO: 52 - DNA, 25 bp, Homo sapiens
actttggtgcctactccattgtggc

SEQ ID NO: 53 - DNA, 25 bp, Homo sapiens
gttctgcaagaggagctattctgat

SEQ ID NO: 54 - DNA, 25 bp, Homo sapiens
aaagctgcaggctgtgacttcacta

SEQ ID NO: 55 - DNA, 25 bp, Homo sapiens
acaccagagctgccgacttggagac

SEQ ID NO: 56 - DNA, 25 bp, Homo sapiens
cacccttcctggacgggactattga

SEQ ID NO: 57 - DNA, 25 bp, Homo sapiens
agaagaagtacacggccaccaaggt

SEQ ID NO: 58 - DNA, 25 bp, Homo sapiens
tcctccattgttgccctggaatgta

SEQ ID NO: 59 - DNA, 25 bp, Homo sapiens
gtagtcttctccatgaattacacgt

SEQ ID NO: 60 - DNA, 25 bp, Homo sapiens
ctgtgagccgcgggactctagagaa

SEQ ID NO: 61 - DNA, 25 bp, Homo sapiens
ggagtaagagccttaggtcagtttg

SEQ ID NO: 62 - DNA, 25 bp, Homo sapiens
aagcactgttggttgtttggttagt

SEQ ID NO: 63 - DNA, 25 bp, Homo sapiens
gactcgctcattggtggaaatgcct

SEQ ID NO: 64 - DNA, 25 bp, Homo sapiens
cagatcgagagcaagactgcttttc

SEQ ID NO: 65 - DNA, 25 bp, Homo sapiens
tggcccgcgtgattgtggcatttaa

SEQ ID NO: 66 - DNA, 25 bp, Homo sapiens
agtaattttatttgttgtcttctga

SEQ ID NO: 67 - DNA, 25 bp, Homo sapiens
atctctgtcagagtatgtttctcgc

SEQ ID NO: 68 - DNA, 25 bp, Homo sapiens
ccttaacttctcgacagttccgtga

SEQ ID NO: 69 - DNA, 25 bp, Homo sapiens
ggaaggtacgataatcccacaccat

SEQ ID NO: 70 - DNA, 25 bp, Homo sapiens
ttactgtattgtgtactggctataa

SEQ ID NO: 71 - DNA, 25 bp, Homo sapiens
gacctactttttatacgacttcgat

SEQ ID NO: 72 - DNA, 25 bp, Homo sapiens
cctgtccattggtgatgttgcgaag

SEQ ID NO: 73 - DNA, 25 bp, Homo sapiens
ggtgagacgggtactttggtggaca

SEQ ID NO: 74 - DNA, 25 bp, Homo sapiens
aaaatctagagacatgagggacata

SEQ ID NO: 75 - DNA, 25 bp, Homo sapiens
gtagcgtggatagctgtgattggtg

SEQ ID NO: 76 - DNA, 25 bp, Homo sapiens
ggttctggctgtttgagattctcaa

SEQ ID NO: 77 - DNA, 25 bp, Homo sapiens
tcagtctaactctgtgtgctacgcc

SEQ ID NO: 78 - DNA, 25 bp, Homo sapiens
gaccatcggcatttctgtggatccg

SEQ ID NO: 79 - DNA, 25 bp, Homo sapiens
aaaaggtcacacagtgcggcttcct

SEQ ID NO: 80 - DNA, 25 bp, Homo sapiens
tggccaatgggactgtgcaagcacc

SEQ ID NO: 81 - DNA, 25 bp, Homo sapiens
aagtgttttctgtaccttagattca

SEQ ID NO: 82 - DNA, 25 bp, Homo sapiens
gtgttcaccaatgagaggttcccat

SEQ ID NO: 83 - DNA, 25 bp, Homo sapiens
ggtgtgcaacaaacaacctacctcg

SEQ ID NO: 84 - DNA, 25 bp, Homo sapiens
tgagcgcttcgatgcggactatgcg

SEQ ID NO: 85 - DNA, 25 bp, Homo sapiens
tatgtcgctgtccaagagaaggctg

SEQ ID NO: 86 - DNA, 25 bp, Homo sapiens
caggtgtgcatgggtccaaggccct

SEQ ID NO: 87 - DNA, 25 bp, Homo sapiens
ttttgtaagtgccatgtttattatc

SEQ ID NO: 88 - DNA, 25 bp, Homo sapiens
tgctgtacctttttgcagaggccaa

SEQ ID NO: 89 - DNA, 25 bp, Homo sapiens
ctcagctgacatttaacacttcctc

SEQ ID NO: 90 - DNA, 25 bp, Homo sapiens
acttggactccatcgttaaaattat

SEQ ID NO: 91 - DNA, 25 bp, Homo sapiens
gaaatggatgtaagcctggcccata

SEQ ID NO: 92 - DNA, 25 bp, Homo sapiens
agctgaccggaccggtcatgcccgt

SEQ ID NO: 93 - DNA, 25 bp, Homo sapiens
tgaaggagtaccgctccaaactcat

SEQ ID NO: 94 - DNA, 25 bp, Homo sapiens
gtcactgtaaatcattcttaagccc

SEQ ID NO: 95 - DNA, 25 bp, Homo sapiens
gagctcagtatttagtcctttgttt

SEQ ID NO: 96 - DNA, 25 bp, Homo sapiens
cttccttcaagatcctggctgggga

SEQ ID NO: 97 - DNA, 25 bp, Homo sapiens
gagggagccatttggtggcgctgct

SEQ ID NO: 98 - DNA, 25 bp, Homo sapiens
cacctttcatatctagggaccaccc

SEQ ID NO: 99 - DNA, 25 bp, Homo sapiens
ttgtgaggtgcggccttgtggacag

SEQ ID NO: 100 - DNA, 25 bp, Homo sapiens
aaatcccctcagaggtgtgactagt

SEQ ID NO: 101 - DNA, 25 bp, Homo sapiens
atcatggcttgtggtctggtcgcca

SEQ ID NO: 102 - DNA, 25 bp, Homo sapiens
ggcccctggagttgtttctgcaggg

SEQ ID NO: 103 - DNA, 25 bp, Homo sapiens
ggctttgccggatggtttgaaacct

SEQ ID NO: 104 - DNA, 25 bp, Homo sapiens
caccgatatattgttaccgctgaaa

SEQ ID NO: 105 - DNA, 25 bp, Homo sapiens
gcttttattcgtcctttgacaaaag

SEQ ID NO: 106 - DNA, 25 bp, Homo sapiens
aatggggggacgagcacatcccagg

SEQ ID NO: 107 - DNA, 25 bp, Homo sapiens
ggtcaagggcaagtcaaagcaacta

SEQ ID NO: 108 - DNA, 25 bp, Homo sapiens
cccggtcatctagcaagctgccgaa

SEQ ID NO: 109 - DNA, 25 bp, Homo sapiens
aaagcaggcaacaacatgctgctgg

SEQ ID NO: 110 - DNA, 25 bp, Homo sapiens
cctatgtgattttaactctgtcttc

SEQ ID NO: 111 - DNA, 25 bp, Homo sapiens
gcactctagagctacttgttcacgt

SEQ ID NO: 112 - DNA, 25 bp, Homo sapiens
gttgaactcatgtttcagttcgcga

SEQ ID NO: 113 - DNA, 25 bp, Homo sapiens
tactttgacttttcagagcacaccc

SEQ ID NO: 114 - DNA, 25 bp, Homo sapiens
cacccacctgtactctggagagact

SEQ ID NO: 115 - DNA, 25 bp, Homo sapiens
aaagcttctatggttgacattgtat

SEQ ID NO: 116 - DNA, 25 bp, Homo sapiens
ttctcttttctgcacttaatacctg

SEQ ID NO: 117 - DNA, 25 bp, Homo sapiens
ggtaggatatcttggctttgccaca

SEQ ID NO: 118 - DNA, 25 bp, Homo sapiens
aggtctttgaaatatgcatgtactt

SEQ ID NO: 119 - DNA, 25 bp, Homo sapiens
gaggacaggtcagctgtctggctca

SEQ ID NO: 120 - DNA, 25 bp, Homo sapiens
gcagtccctcacctgtgaagtggat

SEQ ID NO: 121 - DNA, 25 bp, Homo sapiens
ttgaatgggtccattttgcccttcc

SEQ ID NO: 122 - DNA, 25 bp, Homo sapiens
gagtctagaacgcaaggatctcttg

SEQ ID NO: 123 - DNA, 25 bp, Homo sapiens
tgcatactttgcatctttattcaaa

SEQ ID NO: 124 - DNA, 25 bp, Homo sapiens
gcaccatcccagtgatgttctggca

SEQ ID NO: 125 - DNA, 25 bp, Homo sapiens
gatgggtcgtgtgatgagatgcatt

SEQ ID NO: 126 - DNA, 25 bp, Homo sapiens
cagaaagctgcctggtatatccaaa

SEQ ID NO: 127 - DNA, 25 bp, Homo sapiens
aggatttccatgtagctgtggtgct

SEQ ID NO: 128 - DNA, 25 bp, Homo sapiens
gttacttcatatactctaggacaat

SEQ ID NO: 129 - DNA, 25 bp, Homo sapiens
gttgtgcgctgtgacattcgctaca

SEQ ID NO: 130 - DNA, 25 bp, Homo sapiens
gaactacgcttgctcattttttctt

SEQ ID NO: 131 - DNA, 25 bp, Homo sapiens
gattataaactgtgtctcgacctgt

SEQ ID NO: 132 - DNA, 25 bp, Homo sapiens
cgatcatagtcttaggagttcattt

SEQ ID NO: 133 - DNA, 25 bp, Homo sapiens
tttactgtgcctttgtttttactag

SEQ ID NO: 134 - DNA, 25 bp, Homo sapiens
gcgctcgagatccttcggaaagact

SEQ ID NO: 135 - DNA, 25 bp, Homo sapiens
atctggggcatttacttcgccattc

SEQ ID NO: 136 - DNA, 25 bp, Homo sapiens
gtatttgcagagtattagctttgaa

SEQ ID NO: 137 - DNA, 25 bp, Homo sapiens
gtacacctgccctaaggagaaaata

SEQ ID NO: 138 - DNA, 25 bp, Homo sapiens
gagtctctctcaggcagtgaatcga

SEQ ID NO: 139 - DNA, 25 bp, Homo sapiens
gagggggcagcttcggatactgctt

SEQ ID NO: 140 - DNA, 25 bp, Homo sapiens
aacgacgatttgctgctgtgaaccc

SEQ ID NO: 141 - DNA, 25 bp, Homo sapiens
tatgtaacttacccttgtgagacaa

SEQ ID NO: 142 - DNA, 25 bp, Homo sapiens
ggtataatgtaacttcaccccagcc

SEQ ID NO: 143 - DNA, 25 bp, Homo sapiens
atgctccacgtagctgtaacttcac

SEQ ID NO: 144 - DNA, 25 bp, Homo sapiens
ggccactgaggagtttcttcctgtt

SEQ ID NO: 145 - DNA, 25 bp, Homo sapiens
aacatgctgtgtaagctgtgtccta

SEQ ID NO: 146 - DNA, 25 bp, Homo sapiens
aaaacagttcttctgctggtgactc

SEQ ID NO: 147 - DNA, 25 bp, Homo sapiens
cctcggcaggcatggctggtgcctg

SEQ ID NO: 148 - DNA, 25 bp, Homo sapiens
gagtcgtcagaaactccagaccagt

SEQ ID NO: 149 - DNA, 25 bp, Homo sapiens
gttcggatttgactgcctgtatatg

SEQ ID NO: 150 - DNA, 25 bp, Homo sapiens
ggacgtaatctccacagtcaaagaa

SEQ ID NO: 151 - DNA, 25 bp, Homo sapiens
tgagttgttcaccttaacccattac

SEQ ID NO: 152 - DNA, 25 bp, Homo sapiens
gaacctgccattacctgggcaagga

SEQ ID NO: 153 - DNA, 25 bp, Homo sapiens
aggagctcttagttacccttttgtg

SEQ ID NO: 154 - DNA, 25 bp, Homo sapiens
gataacgctgaagcaggcctctcat

SEQ ID NO: 155 - DNA, 25 bp, Homo sapiens
ccgctgcgcgattgacacgcatatt

SEQ ID NO: 156 - DNA, 25 bp, Homo sapiens
ccttggatccgggcacagttgtgag

SEQ ID NO: 157 - DNA, 25 bp, Homo sapiens
atcgcagatccggggcacaaagagg

SEQ ID NO: 158 - DNA, 25 bp, Homo sapiens
tacccctgggaggtgccagtcattg

SEQ ID NO: 159 - DNA, 25 bp, Homo sapiens
aatcgttctccttacaatcaagttc

SEQ ID NO: 160 - DNA, 25 bp, Homo sapiens
agcaaacacaacctctggtcctata

SEQ ID NO: 161 - DNA, 25 bp, Homo sapiens
tgctcatacagcaggccatagaccc

SEQ ID NO: 162 - DNA, 25 bp, Homo sapiens
gagctatctaggtttgtctggaaag

SEQ ID NO: 163 - DNA, 25 bp, Homo sapiens
ccctaacgagacacatttgcccaaa

SEQ ID NO: 164 - DNA, 25 bp, Homo sapiens
ctcacccaggcaatcttgccttctg

SEQ ID NO: 165 - DNA, 25 bp, Homo sapiens
gcagccaaggtctgtgttcagcact

SEQ ID NO: 166 - DNA, 25 bp, Homo sapiens
gttggacacctttaggttctttgct

SEQ ID NO: 167 - DNA, 25 bp, Homo sapiens
gacaggttgtcatcagcttgtccca

SEQ ID NO: 168 - DNA, 25 bp, Homo sapiens
gatccatgatggctctcttagtcca

SEQ ID NO: 169 - DNA, 25 bp, Homo sapiens
ggacaccccaaattccagaatggct

SEQ ID NO: 170 - DNA, 25 bp, Homo sapiens
gccaggccccatggagggtatactg

SEQ ID NO: 171 - DNA, 25 bp, Homo sapiens
atcatcatgtcactgtggggaccca

SEQ ID NO: 172 - DNA, 25 bp, Homo sapiens
agaactgtcttacaccacttgagct

SEQ ID NO: 173 - DNA, 25 bp, Homo sapiens
ttattattactgtttgtcttctccc

SEQ ID NO: 174 - DNA, 25 bp, Homo sapiens
gtttgtttgcttaatttccttctgt

SEQ ID NO: 175 - DNA, 25 bp, Homo sapiens
agagagtgtggtgctttttctggtc

SEQ ID NO: 176 - DNA, 25 bp, Homo sapiens
ggatcacctacttactgtattctac

SEQ ID NO: 177 - DNA, 25 bp, Homo sapiens
ataacgtgcggtcatacctttcttc

SEQ ID NO: 178 - DNA, 25 bp, Homo sapiens
gagattcctccttatgatgtatgct

SEQ ID NO: 179 - DNA, 25 bp, Homo sapiens
gaaccacaggtaccagatgggctgc

SEQ ID NO: 180 - DNA, 25 bp, Homo sapiens
ataacattagtgtatttctcctgtg

SEQ ID NO: 181 - DNA, 25 bp, Homo sapiens
ttcatttatggatcgagcctcgtga

SEQ ID NO: 182 - DNA, 25 bp, Homo sapiens
gaaatgggaatcatggcctcttgaa

SEQ ID NO: 183 - DNA, 25 bp, Homo sapiens
atctatatggaattgcttaccaaag

SEQ ID NO: 184 - DNA, 25 bp, Homo sapiens
gctgtatgagactttgtgcatttta

SEQ ID NO: 185 - DNA, 25 bp, Homo sapiens
tttcgccttaaactctggacactct

SEQ ID NO: 186 - DNA, 25 bp, Homo sapiens
tgaagacctggttttgatgctgcct

SEQ ID NO: 187 - DNA, 25 bp, Homo sapiens
actgatgtaacctcaaagcctctca

SEQ ID NO: 188 - DNA, 25 bp, Homo sapiens
tttaagggctaatctcacacctcct

SEQ ID NO: 189 - DNA, 25 bp, Homo sapiens
ggcgtgtttatgcgagtgagcgagg

SEQ ID NO: 190 - DNA, 25 bp, Homo sapiens
tcaacagagtatttcccttggccga

SEQ ID NO: 191 - DNA, 25 bp, Homo sapiens
aatttgcactgttacattttggttc

SEQ ID NO: 192 - DNA, 25 bp, Homo sapiens
caagcgcatctcggagcagttcact

SEQ ID NO: 193 - DNA, 25 bp, Homo sapiens
tgattctgttcggactgggttctca

SEQ ID NO: 194 - DNA, 25 bp, Homo sapiens
aactgcttttgtacctagctaggct

SEQ ID NO: 195 - DNA, 25 bp, Homo sapiens
aggacattaggattggtgctcagaa

SEQ ID NO: 196 - DNA, 25 bp, Homo sapiens
gagtgagcacactggctttgcatcc

SEQ ID NO: 197 - DNA, 25 bp, Homo sapiens
ggaattccttgtaactggagctcgg

SEQ ID NO: 198 - DNA, 25 bp, Homo sapiens
ggtaattaatccattcctggcataa

SEQ ID NO: 199 - DNA, 25 bp, Homo sapiens
gcattaggtatgacttgttctgagt

SEQ ID NO: 200 - DNA, 25 bp, Homo sapiens
gttgtggccaatgtcgaaacctaca

SEQ ID NO: 201 - DNA, 25 bp, Homo sapiens
agacctccacttcgaaggcatgttc

SEQ ID NO: 202 - DNA, 25 bp, Homo sapiens
gtggagttcctacatgcagtgagtg

SEQ ID NO: 203 - DNA, 25 bp, Homo sapiens
tcatgtgcacatgccgttgcagcac

SEQ ID NO: 204 - DNA, 25 bp, Homo sapiens
taaagagcttccatctgggctggac

SEQ ID NO: 205 - DNA, 25 bp, Homo sapiens
accgatgtgtctatggtgctgcacc

SEQ ID NO: 206 - DNA, 25 bp, Homo sapiens
aacgggattacatattcttcagatt

SEQ ID NO: 207 - DNA, 25 bp, Homo sapiens
gcctcaagaggcctggcaagaaagg

SEQ ID NO: 208 - DNA, 25 bp, Homo sapiens
agaatctggggtttgccagtcagtt

SEQ ID NO: 209 - DNA, 25 bp, Homo sapiens
gaggtggctgggtttacacgctaat

SEQ ID NO: 210 - DNA, 25 bp, Homo sapiens
tgcgaatctgacttacgccattatt

SEQ ID NO: 211 - DNA, 25 bp, Homo sapiens
gaaggttctgaacccacgagtggca

SEQ ID NO: 212 - DNA, 25 bp, Homo sapiens
tggctgaatttcagagcatcccgcg

SEQ ID NO: 213 - DNA, 25 bp, Homo sapiens
agcaatgtggagaggcgtccagccc

SEQ ID NO: 214 - DNA, 25 bp, Homo sapiens
cctctttctcaatctataacctttg

SEQ ID NO: 215 - DNA, 25 bp, Homo sapiens
ccctgctacgactggcaaagatgag

SEQ ID NO: 216 - DNA, 25 bp, Homo sapiens
attgcatatgcatagttcccatgtt

SEQ ID NO: 217 - DNA, 25 bp, Homo sapiens
acttttaagtccagctattcattag

SEQ ID NO: 218 - DNA, 25 bp, Homo sapiens
gattcctgaactcaaggtaccagca

SEQ ID NO: 219 - DNA, 25 bp, Homo sapiens
taaccatgcttacacactaaactat

SEQ ID NO: 220 - DNA, 25 bp, Homo sapiens
ggaatgaccaggtctatcagcccct

SEQ ID NO: 221 - DNA, 25 bp, Homo sapiens
gttgtgttatagtttatgcttctta

SEQ ID NO: 222 - DNA, 25 bp, Homo sapiens
ctctccactcaatgtcttaggtcag

SEQ ID NO: 223 - DNA, 25 bp, Homo sapiens
gcatgtttaacatccagcactgtaa

SEQ ID NO: 224 - DNA, 25 bp, Homo sapiens
ggtaatcttctatgtcagagctagt

SEQ ID NO: 225 - DNA, 25 bp, Homo sapiens
tgcataccttctgtacattctgggg

SEQ ID NO: 226 - DNA, 25 bp, Homo sapiens
gaacatttctcttgtgttcctgact

SEQ ID NO: 227 - DNA, 25 bp, Homo sapiens
tgattcacttcacgctttcagcgaa

SEQ ID NO: 228 - DNA, 25 bp, Homo sapiens
agtggccacatcatttccacgtttt

SEQ ID NO: 229 - DNA, 25 bp, Homo sapiens
gaaagatccttgtctgattttggca

SEQ ID NO: 230 - DNA, 25 bp, Homo sapiens
tactcatcctgctatcaatttctta

SEQ ID NO: 231 - DNA, 25 bp, Homo sapiens
atcactctttgcacactcttgtgtt

SEQ ID NO: 232 - DNA, 25 bp, Homo sapiens
ggattttcacgatgttcctgtctgc

SEQ ID NO: 233 - DNA, 25 bp, Homo sapiens
ccaaggggtgctgtatgctctaggc

SEQ ID NO: 234 - DNA, 25 bp, Homo sapiens
agggttactgatcacttaccttctt

SEQ ID NO: 235 - DNA, 25 bp, Homo sapiens
tctaaataatgcccagtcttctccc

SEQ ID NO: 236 - DNA, 25 bp, Homo sapiens
gtactatggttgtccaacacaggcc

SEQ ID NO: 237 - DNA, 25 bp, Homo sapiens
gatagtccatgcgaaggctgtatat

SEQ ID NO: 238 - DNA, 25 bp, Homo sapiens
atcaccagaataaacccagcttccc

SEQ ID NO: 239 - DNA, 25 bp, Homo sapiens
aatatccaatattcgctgtgtcagc

SEQ ID NO: 240 - DNA, 25 bp, Homo sapiens
ggttaagtccttactgagcaacgat

SEQ ID NO: 241 - DNA, 25 bp, Homo sapiens
gacacctgtgtttcagcatttggag

SEQ ID NO: 242 - DNA, 25 bp, Homo sapiens
gccagtcaggacttttgctattgca

SEQ ID NO: 243 - DNA, 25 bp, Homo sapiens
gtggaccatcgagtcatcttgggca

SEQ ID NO: 244 - DNA, 25 bp, Homo sapiens
gctgtccaatatgtagccgctagcc

SEQ ID NO: 245 - DNA, 25 bp, Homo sapiens
aggattatacttactcagctgttaa

SEQ ID NO: 246 - DNA, 25 bp, Homo sapiens
gcctgactccgctgggagagtgcag

SEQ ID NO: 247 - DNA, 25 bp, Homo sapiens
gctgattgtcttgaccaaacccaca

SEQ ID NO: 248 - DNA, 25 bp, Homo sapiens
gacagctgccttgataccagctctc

SEQ ID NO: 249 - DNA, 25 bp, Homo sapiens
acctatgatctgaagagcgtcctgg

SEQ ID NO: 250 - DNA, 25 bp, Homo sapiens
taaatgccaacactgtcttctcatg

SEQ ID NO: 251 - DNA, 25 bp, Homo sapiens
ttcactgatgctgagccagtttgta

SEQ ID NO: 252 - DNA, 25 bp, Homo sapiens
gtcatggacagtggctatcggccta

SEQ ID NO: 253 - DNA, 25 bp, Homo sapiens
tcagcagattttgcccactattcct

SEQ ID NO: 254 - DNA, 25 bp, Homo sapiens
acatgtgtaattagtcggcagctca

SEQ ID NO: 255 - DNA, 25 bp, Homo sapiens
tctgtgtgccctgaaaatgttacca

SEQ ID NO: 256 - DNA, 25 bp, Homo sapiens
tccatctagtgacaagtgaccccca

SEQ ID NO: 257 - DNA, 25 bp, Homo sapiens
gctgatggacagtggccttctaaaa

SEQ ID NO: 258 - DNA, 25 bp, Homo sapiens
cggagaggtggtgttacgctttgct

SEQ ID NO: 259 - DNA, 25 bp, Homo sapiens
gacacattgttgaaacaggcccaga

SEQ ID NO: 260 - DNA, 25 bp, Homo sapiens
attcccagtagtgacagtggatata

SEQ ID NO: 261 - DNA, 25 bp, Homo sapiens
gcctctgacttggtatttccaggtc

SEQ ID NO: 262 - DNA, 25 bp, Homo sapiens
cccatatcccttctgtaatttgtac

SEQ ID NO: 263 - DNA, 25 bp, Homo sapiens
catatgccaacacggggtctgggtg

SEQ ID NO: 264 - DNA, 25 bp, Homo sapiens
acatactcctggcattgcacttttt

SEQ ID NO: 265 - DNA, 25 bp, Homo sapiens
atgctcaagtcccatggcacagagc

SEQ ID NO: 266 - DNA, 25 bp, Homo sapiens
gcctttcaagcgacagatgcctcat

SEQ ID NO: 267 - DNA, 25 bp, Homo sapiens
taagcattccgtccatctaagctca

SEQ ID NO: 268 - DNA, 25 bp, Homo sapiens
gtgcgagtctgagtcagagatttgg

SEQ ID NO: 269 - DNA, 25 bp, Homo sapiens
tgatgtgatcatccctagaggtgca

SEQ ID NO: 270 - DNA, 25 bp, Homo sapiens
gatgaacctattctgaagcacttga

SEQ ID NO: 271 - DNA, 25 bp, Homo sapiens
agagctccttggttttttacttctg

SEQ ID NO: 272 - DNA, 25 bp, Homo sapiens
aaatattacttcatgttcctccttt

SEQ ID NO: 273 - DNA, 25 bp, Homo sapiens
tcaaggaaggtggtcctcagctcgg

SEQ ID NO: 274 - DNA, 25 bp, Homo sapiens
gaacaaaatttgcactctaccagat

SEQ ID NO: 275 - DNA, 25 bp, Homo sapiens
gaaacttcaccagactttttcttct

SEQ ID NO: 276 - DNA, 25 bp, Homo sapiens
ccattctcagcagactccagtattg

SEQ ID NO: 277 - DNA, 25 bp, Homo sapiens
gactccacaggcaaatactggacgg

SEQ ID NO: 278 - DNA, 25 bp, Homo sapiens
gactatatctaattcctctgatcac

SEQ ID NO: 279 - DNA, 25 bp, Homo sapiens
gaccaacttaccacagatctgaact

SEQ ID NO: 280 - DNA, 25 bp, Homo sapiens
ccttggacaaattccatccagcttt

SEQ ID NO: 281 - DNA, 25 bp, Homo sapiens
gtgagaaagcttttgtggctggttt

SEQ ID NO: 282 - DNA, 25 bp, Homo sapiens
cacaacacttatgtatgcaccccaa

SEQ ID NO: 283 - DNA, 25 bp, Homo sapiens
gggttgtacagggtgccagatagat

SEQ ID NO: 284 - DNA, 25 bp, Homo sapiens
ctgctggaaacagactcgattcata

SEQ ID NO: 285 - DNA, 25 bp, Homo sapiens
gtgctctacggaaacgtattcgaga

SEQ ID NO: 286 - DNA, 25 bp, Homo sapiens
gctgtacttttgatagctgtgccag

SEQ ID NO: 287 - DNA, 25 bp, Homo sapiens
cagaccgctggaaaacactgtcact

SEQ ID NO: 288 - DNA, 25 bp, Homo sapiens
ctttttcctgggtcatgctgcaaca

SEQ ID NO: 289 - DNA, 25 bp, Homo sapiens
tattcttgctgtactcattggtagt

SEQ ID NO: 290 - DNA, 25 bp, Homo sapiens
tggacacattttatcctgatccaca

SEQ ID NO: 291 - DNA, 25 bp, Homo sapiens
agaccataccagacctaatttgcaa

SEQ ID NO: 292 - DNA, 25 bp, Homo sapiens
accctccagattactacggctatga

SEQ ID NO: 293 - DNA, 25 bp, Homo sapiens
tggagagagaggactcggggtcttc

SEQ ID NO: 294 - DNA, 25 bp, Homo sapiens
agatctactagaccatgggccaaag

SEQ ID NO: 295 - DNA, 25 bp, Homo sapiens
gcctttcttgctgttaggggctacc

SEQ ID NO: 296 - DNA, 25 bp, Homo sapiens
gcaggacttcccttataaagcaaaa

SEQ ID NO: 297 - DNA, 25 bp, Homo sapiens
gatttctttggctacctgtgcataa

SEQ ID NO: 298 - DNA, 25 bp, Homo sapiens
aataactttatgtggcactgcctag

SEQ ID NO: 299 - DNA, 25 bp, Homo sapiens
cagggacacatttctctgtcttttt

SEQ ID NO: 300 - DNA, 25 bp, Homo sapiens
acagaattccactgttctgctcggt

SEQ ID NO: 301 - DNA, 25 bp, Homo sapiens
gtttgcagttacaggccagttctcc

SEQ ID NO: 302 - DNA, 25 bp, Homo sapiens
gtctgggtttgcagatgggtgccct

SEQ ID NO: 303 - DNA, 25 bp, Homo sapiens
tctgtcacctcattggtccatgaag

SEQ ID NO: 304 - DNA, 25 bp, Homo sapiens
gagccaacatcacgttttgttagct

SEQ ID NO: 305 - DNA, 25 bp, Homo sapiens
gactgctcatggattttgtagctgt

SEQ ID NO: 306 - DNA, 25 bp, Homo sapiens
agctgaggaaattccgcttccgaaa

SEQ ID NO: 307 - DNA, 25 bp, Homo sapiens
aaatgtgaccctcgccatggtaaat

SEQ ID NO: 308 - DNA, 25 bp, Homo sapiens
ctgcaccattcaaactagccaaccc

SEQ ID NO: 309 - DNA, 25 bp, Homo sapiens
ggcctcagggtctaaggagcgctag

SEQ ID NO: 310 - DNA, 25 bp, Homo sapiens
aggcagctattttaccatctggtat

SEQ ID NO: 311 - DNA, 25 bp, Homo sapiens
taggcctaattcgttttcctttgtg

SEQ ID NO: 312 - DNA, 25 bp, Homo sapiens
ccgaggcctggggtagagcagactg

SEQ ID NO: 313 - DNA, 25 bp, Homo sapiens
cccctgcagttcagcagttaacaga

SEQ ID NO: 314 - DNA, 25 bp, Homo sapiens
gtatggtgctggtcgagggaactat

SEQ ID NO: 315 - DNA, 25 bp, Homo sapiens
gattcttgcacatgaactgtcacat

SEQ ID NO: 316 - DNA, 25 bp, Homo sapiens
catgtgacgttttgactggcttgag

SEQ ID NO: 317 - DNA, 25 bp, Homo sapiens
gccgtatatagatcaatgtccacat

SEQ ID NO: 318 - DNA, 25 bp, Homo sapiens
tggtggagcaggctgaccacatcct

SEQ ID NO: 319 - DNA, 25 bp, Homo sapiens
ctccagtgcaacacatccatctgaa

SEQ ID NO: 320 - DNA, 25 bp, Homo sapiens
tggagaaaatgacgacccacgacca

SEQ ID NO: 321 - DNA, 25 bp, Homo sapiens
actgataggcagttctctggggccc

SEQ ID NO: 322 - DNA, 25 bp, Homo sapiens
ccaccagatcatggcccacgtggag

SEQ ID NO: 323 - DNA, 25 bp, Homo sapiens
aaacagagatccacaacaagctttt

SEQ ID NO: 324 - DNA, 25 bp, Homo sapiens
tgttcgtggtgagctacgccaagga

SEQ ID NO: 325 - DNA, 25 bp, Homo sapiens
gagggcatgctcactagtggttagt

SEQ ID NO: 326 - DNA, 25 bp, Homo sapiens
gtaggcctgtactaatctctacgca

SEQ ID NO: 327 - DNA, 25 bp, Homo sapiens
tggcagcatcttgtcatacgtgtca

SEQ ID NO: 328 - DNA, 25 bp, Homo sapiens
ccagcaacctctacatccaggaatg

SEQ ID NO: 329 - DNA, 25 bp, Homo sapiens
gattcctcgaaactgccattgtgat

SEQ ID NO: 330 - DNA, 25 bp, Homo sapiens
atggccgaccggatcaggaagtatc

SEQ ID NO: 331 - DNA, 25 bp, Homo sapiens
ggtgtgaaggtgctgtatcccggaa

SEQ ID NO: 332 - DNA, 25 bp, Homo sapiens
tggatccacgagcccaagggctacc

SEQ ID NO: 333 - DNA, 25 bp, Homo sapiens
agtgagtgtcttgacattttcaccc

SEQ ID NO: 334 - DNA, 25 bp, Homo sapiens
gaggctcaccttagagcttctgagt

SEQ ID NO: 335 - DNA, 25 bp, Homo sapiens
ggtagcaggttccataggcgtacaa

SEQ ID NO: 336 - DNA, 25 bp, Homo sapiens
gatgctggtgctaaacctccaagtg

SEQ ID NO: 337 - DNA, 25 bp, Homo sapiens
taatgctctttgtatggcagtatgt

SEQ ID NO: 338 - DNA, 25 bp, Homo sapiens
tgacctcggtcacaaaagcagtttt

SEQ ID NO: 339 - DNA, 25 bp, Homo sapiens
gctaatgccgagatcttctaccagc

SEQ ID NO: 340 - DNA, 25 bp, Homo sapiens
ccttatgtaaggtagaccctcctag

SEQ ID NO: 341 - DNA, 25 bp, Homo sapiens
gattgtgtgtctatccaacagggag

SEQ ID NO: 342 - DNA, 25 bp, Homo sapiens
ccacgtgggtgcatcgctgatcgtg

SEQ ID NO: 343 - DNA, 25 bp, Homo sapiens
tccagctttccacacagttgttgct

SEQ ID NO: 344 - DNA, 25 bp, Homo sapiens
gagttgcctgtttgtctctggagat

SEQ ID NO: 345 - DNA, 25 bp, Homo sapiens
cccggtgtgcgaggatcacagcgag

SEQ ID NO: 346 - DNA, 25 bp, Homo sapiens
atagcagaagcggtgcctggcagga

SEQ ID NO: 347 - DNA, 25 bp, Homo sapiens
cttccatgtagtccctcttggtaat

SEQ ID NO: 348 - DNA, 25 bp, Homo sapiens
ataggtcagttactggtctctttct

SEQ ID NO: 349 - DNA, 25 bp, Homo sapiens
gggaaggatgttggcagcgacacca

SEQ ID NO: 350 - DNA, 25 bp, Homo sapiens
gaccttgcgctgagtgaatctgtgt

SEQ ID NO: 351 - DNA, 25 bp, Homo sapiens
caggtgttccctgagttgtttgcag

SEQ ID NO: 352 - DNA, 25 bp, Homo sapiens
tatctctccatgttcagttccaagg

SEQ ID NO: 353 - DNA, 25 bp, Homo sapiens
aaaggccacactggtgtgcctggcc

SEQ ID NO: 354 - DNA, 25 bp, Homo sapiens
atctcaatgaagccagctcacagtg

SEQ ID NO: 355 - DNA, 25 bp, Homo sapiens
tgattgtgccttataacctgccttt

SEQ ID NO: 356 - DNA, 25 bp, Homo sapiens
gaatggtattcgtttcacctgttgt

SEQ ID NO: 357 - DNA, 25 bp, Homo sapiens
tacagccaggcataacatatccact

SEQ ID NO: 358 - DNA, 25 bp, Homo sapiens
gttttatgctcttattccaagttca

SEQ ID NO: 359 - DNA, 25 bp, Homo sapiens
gcatgtctgctgggtgtgaccatgt

SEQ ID NO: 360 - DNA, 25 bp, Homo sapiens
ccaagtatgtctagtcaccttttaa

SEQ ID NO: 361 - DNA, 25 bp, Homo sapiens
gtcgtctgatctgacgttttctacg

SEQ ID NO: 362 - DNA, 25 bp, Homo sapiens
cctgctgcctctgatcgtaggaatt

SEQ ID NO: 363 - DNA, 25 bp, Homo sapiens
gtctagcatctcaaggctgatctgg

SEQ ID NO: 364 - DNA, 25 bp, Homo sapiens
atgtctgctgggtgtgaccatgttt

SEQ ID NO: 365 - DNA, 25 bp, Homo sapiens
tgaaatgggacccctgctgattctt

SEQ ID NO: 366 - DNA, 25 bp, Homo sapiens
aggcagacttctctggaatgtccca

SEQ ID NO: 367 - DNA, 25 bp, Homo sapiens
agacacatgctgaggttttgaataa

SEQ ID NO: 368 - DNA, 25 bp, Homo sapiens
attgaagacagtacaggctgctgta

SEQ ID NO: 369 - DNA, 25 bp, Homo sapiens
tctgttccctctcttttgaaaatgt

SEQ ID NO: 370 - DNA, 25 bp, Homo sapiens
tctcctaaccctctagttttaattg

SEQ ID NO: 371 - DNA, 25 bp, Homo sapiens
gaatatcacagcttaccttgggaat

SEQ ID NO: 372 - DNA, 25 bp, Homo sapiens
atctgcgtgaacggggacgacgccc

SEQ ID NO: 373 - DNA, 25 bp, Homo sapiens
tctctgggtctgattttctcactga

SEQ ID NO: 374 - DNA, 25 bp, Homo sapiens
aagaccattagaaagcaccaggccg

SEQ ID NO: 375 - DNA, 25 bp, Homo sapiens
atattccatcctttttactgatttt

SEQ ID NO: 376 - DNA, 25 bp, Homo sapiens
aaattacccatattgactttcacac

SEQ ID NO: 377 - DNA, 25 bp, Homo sapiens
atgcgtgcataccacttttgttctt

SEQ ID NO: 378 - DNA, 25 bp, Homo sapiens
gagctgctgagacgacgctcacaga

SEQ ID NO: 379 - DNA, 25 bp, Homo sapiens
gatacctgccttgtacttagtacct

SEQ ID NO: 380 - DNA, 25 bp, Homo sapiens
aagttggtcttaagcttccaccttg

SEQ ID NO: 381 - DNA, 25 bp, Homo sapiens
gaaagtccatgatgagctccgtgag

SEQ ID NO: 382 - DNA, 25 bp, Homo sapiens
tcccttcacttatcagcatactatt

SEQ ID NO: 383 - DNA, 25 bp, Homo sapiens
atagagctttttcctttatcagtcc

SEQ ID NO: 384 - DNA, 25 bp, Homo sapiens
agagccccagtttgtaaatgaacct

SEQ ID NO: 385 - DNA, 25 bp, Homo sapiens
acttggactccatcgttaaaattat

SEQ ID NO: 386 - DNA, 25 bp, Homo sapiens
gctgtggatctgtttggccagggtc

SEQ ID NO: 387 - DNA, 25 bp, Homo sapiens
gaaatcctttcacctgtggacatta

SEQ ID NO: 388 - DNA, 25 bp, Homo sapiens
atcgtcacagccaagtaataaccca

SEQ ID NO: 389 - DNA, 25 bp, Homo sapiens
gaccttcaagggtcctcgttttgat

SEQ ID NO: 390 - DNA, 25 bp, Homo sapiens
ccctgcccgcgaagtgacagtttac

SEQ ID NO: 391 - DNA, 25 bp, Homo sapiens
agcaatgtgctcctgatcaagtaga

SEQ ID NO: 392 - DNA, 25 bp, Homo sapiens
ttctctgtgccagatcttcagtgcc

SEQ ID NO: 393 - DNA, 25 bp, Homo sapiens
caagaccgtttgtccacttcatttt

SEQ ID NO: 394 - DNA, 25 bp, Homo sapiens
ttcactcttggctttcttatgttgc

SEQ ID NO: 395 - DNA, 25 bp, Homo sapiens
atagcacatgcttgtaacagaggag

SEQ ID NO: 396 - DNA, 25 bp, Homo sapiens
gaatagtgtcaccaattccaccaag

SEQ ID NO: 397 - DNA, 25 bp, Homo sapiens
atactctccacatttctgtttgagg

SEQ ID NO: 398 - DNA, 25 bp, Homo sapiens
tcatgttctgtgtcacgtgaccctg

SEQ ID NO: 399 - DNA, 25 bp, Homo sapiens
acgtgacacctgtgaaggctggccg

SEQ ID NO: 400 - DNA, 25 bp, Homo sapiens
tcacatgatgatacctgcttttctc

SEQ ID NO: 401 - DNA, 25 bp, Homo sapiens
agagtccttggaacaagcaactggc

SEQ ID NO: 402 - DNA, 25 bp, Homo sapiens
ctgttctttctggcagctatcttac

SEQ ID NO: 403 - DNA, 25 bp, Homo sapiens
cgcatctctgtgcctattgatttgc

SEQ ID NO: 404 - DNA, 25 bp, Homo sapiens
tagtcattcacctctgcttatatga

SEQ ID NO: 405 - DNA, 25 bp, Homo sapiens
gaggacacattttggcattcttgct

SEQ ID NO: 406 - DNA, 25 bp, Homo sapiens
gttgtagctgccatcagatgccgga

SEQ ID NO: 407 - DNA, 25 bp, Homo sapiens
ccccgatgacctgggatggtggcca

SEQ ID NO: 408 - DNA, 25 bp, Homo sapiens
gtgtcggacagccagatggtcatca

SEQ ID NO: 409 - DNA, 25 bp, Homo sapiens
ttctcacttttcatccaggaagccg

SEQ ID NO: 410 - DNA, 25 bp, Homo sapiens
ggagtcccaaatgtcatcaggtttt

SEQ ID NO: 411 - DNA, 25 bp, Homo sapiens
gaaccagcactgtttagcctgatac

SEQ ID NO: 412 - DNA, 25 bp, Homo sapiens
taaataggagcctttctactggttt

SEQ ID NO: 413 - DNA, 25 bp, Homo sapiens
gctccagaagcgcttggacaggctg

SEQ ID NO: 414 - DNA, 25 bp, Homo sapiens
tgaagagcaagactgccaagctcca

SEQ ID NO: 415 - DNA, 25 bp, Homo sapiens
gccttggcagacttacgatctcaac

SEQ ID NO: 416 - DNA, 25 bp, Homo sapiens
aatcatttggcattcacatgtggct

SEQ ID NO: 417 - DNA, 25 bp, Homo sapiens
tagagaaaggccagcgtttcaccct

SEQ ID NO: 418 - DNA, 25 bp, Homo sapiens
tcctccattgttgccctggaatgta

SEQ ID NO: 419 - DNA, 25 bp, Homo sapiens
gctgctatggtcttagcctgtagac

SEQ ID NO: 420 - DNA, 25 bp, Homo sapiens
tgagactctgcactatgagaccttc

SEQ ID NO: 421 - DNA, 25 bp, Homo sapiens
cagcctgccataggatccaactgga

SEQ ID NO: 422 - DNA, 25 bp, Homo sapiens
gtggaaatgcgcatgagtccccaac

SEQ ID NO: 423 - DNA, 25 bp, Homo sapiens
ttttgccaagagagccatccagact

SEQ ID NO: 424 - DNA, 25 bp, Homo sapiens
agaaaatagcagacgtttcccctct

SEQ ID NO: 425 - DNA, 25 bp, Homo sapiens
gtgagcgacatgtgcagaacggccc

SEQ ID NO: 426 - DNA, 25 bp, Homo sapiens
ggtttgcctcattgtgctatttgcc

SEQ ID NO: 427 - DNA, 25 bp, Homo sapiens
tgttctgcagctcaaattccatttt

SEQ ID NO: 428 - DNA, 25 bp, Homo sapiens
gagttgataaacatttccatcttca

SEQ ID NO: 429 - DNA, 25 bp, Homo sapiens
gcaacctcacaaccttggctgagtc

SEQ ID NO: 430 - DNA, 25 bp, Homo sapiens
tgcctatcgggaggtgtctcgggcc

SEQ ID NO: 431 - DNA, 25 bp, Homo sapiens
gatggagggccagctgaggggaagt

SEQ ID NO: 432 - DNA, 25 bp, Homo sapiens
gtatgttacccttcagtaagttctc

SEQ ID NO: 433 - DNA, 25 bp, Homo sapiens
cagtgtcccaatccgggttgtggaa

SEQ ID NO: 434 - DNA, 25 bp, Homo sapiens
ttcatatccatgatcttgagtccat

SEQ ID NO: 435 - DNA, 25 bp, Homo sapiens
cctagcttcaccttattctttaaag

SEQ ID NO: 436 - DNA, 25 bp, Homo sapiens
gaggatgagagcccagaggtaacag

SEQ ID NO: 437 - DNA, 25 bp, Homo sapiens
aagaccagatctatgaagcccacca

SEQ ID NO: 438 - DNA, 25 bp, Homo sapiens
gagctgatctgcatctgtttatcca

SEQ ID NO: 439 - DNA, 25 bp, Homo sapiens
tgaaacagaggttctccgtttttgg

SEQ ID NO: 440 - DNA, 25 bp, Homo sapiens
agcttctctacgcatttgctgaggc

SEQ ID NO: 441 - DNA, 25 bp, Homo sapiens
ctcacccacagagcccgtgaagagg

SEQ ID NO: 442 - DNA, 25 bp, Homo sapiens
gcctctgctacagcgtggagtggga

SEQ ID NO: 443 - DNA, 25 bp, Homo sapiens
ggaaggtgaatgtgttcccgtcctc

SEQ ID NO: 444 - DNA, 25 bp, Homo sapiens
tgttttctctgggtacaccccaagc

SEQ ID NO: 445 - DNA, 25 bp, Homo sapiens
gggcctatgggattgccatggtgac

SEQ ID NO: 446 - DNA, 25 bp, Homo sapiens
tacaactgtgtttaatctccaaagc

SEQ ID NO: 447 - DNA, 25 bp, Homo sapiens
tccaaagaggagccggtcagcagtg

SEQ ID NO: 448 - DNA, 25 bp, Homo sapiens
atcttcctgctataaatgtgggtgt

SEQ ID NO: 449 - DNA, 25 bp, Homo sapiens
gtgcccttcagagccagtagcaggc

SEQ ID NO: 450 - DNA, 25 bp, Homo sapiens
cttagtttgatcttccatggtggac

SEQ ID NO: 451 - DNA, 25 bp, Homo sapiens
gtctgacctcagtagctattaaata

SEQ ID NO: 452 - DNA, 25 bp, Homo sapiens
gagtaagaaatgctgcccatgccac

SEQ ID NO: 453 - DNA, 25 bp, Homo sapiens
gacccgagaggtgcagacaaatgac

SEQ ID NO: 454 - DNA, 25 bp, Homo sapiens
gaacactgcatatccagttatcagc

SEQ ID NO: 455 - DNA, 25 bp, Homo sapiens
gttggctgccttactacattgggat

SEQ ID NO: 456 - DNA, 25 bp, Homo sapiens
gtaaccattttctatttgtgcaaac

SEQ ID NO: 457 - DNA, 25 bp, Homo sapiens
gaggatgacgatgtcgataccaaga

SEQ ID NO: 458 - DNA, 25 bp, Homo sapiens
gcattggttcagcatcaggagtggg

SEQ ID NO: 459 - DNA, 25 bp, Homo sapiens
ctaggcatgacagtgggcaccttcc

SEQ ID NO: 460 - DNA, 25 bp, Homo sapiens
gcctgcgcaaggtggcctgtattgg

SEQ ID NO: 461 - DNA, 25 bp, Homo sapiens
gtttttcctgttcttaagacgtgat

SEQ ID NO: 462 - DNA, 25 bp, Homo sapiens
ttggcctctcatctcagtggatata

SEQ ID NO: 463 - DNA, 25 bp, Homo sapiens
aagaccggcagatggtggtgctgga

SEQ ID NO: 464 - DNA, 25 bp, Homo sapiens
gggccagtgttacagtgttaccctg

SEQ ID NO: 465 - DNA, 25 bp, Homo sapiens
gagagtccccggaaagatgatgcaa

SEQ ID NO: 466 - DNA, 25 bp, Homo sapiens
catgccaggatttatcagcattccc

SEQ ID NO: 467 - DNA, 25 bp, Homo sapiens
agaaattcttctagccatgttgatg

SEQ ID NO: 468 - DNA, 25 bp, Homo sapiens
gccgagagagcctgccggatgatga

SEQ ID NO: 469 - DNA, 25 bp, Homo sapiens
gagaggtggaagaccatgtctgcta

SEQ ID NO: 470 - DNA, 25 bp, Homo sapiens
attacagaactaccagcatctgctc

SEQ ID NO: 471 - DNA, 25 bp, Homo sapiens
acataaatgggcctggcagcctcgg

SEQ ID NO: 472 - DNA, 25 bp, Homo sapiens
tggttgaatctgaaaccctccttct

SEQ ID NO: 473 - DNA, 25 bp, Homo sapiens
aacctcctcaagatgcggcagggtg

SEQ ID NO: 474 - DNA, 25 bp, Homo sapiens
acgcccctgctgacgaggaaaatgg

SEQ ID NO: 475 - DNA, 25 bp, Homo sapiens
gagccttttgttttacggtatattg

SEQ ID NO: 476 - DNA, 25 bp, Homo sapiens
gttcagaaatcacctttagtcaaaa

SEQ ID NO: 477 - DNA, 25 bp, Homo sapiens
gtgctctgttctacttaatgttctg

SEQ ID NO: 478 - DNA, 25 bp, Homo sapiens
gcatcttcccattgtcgaattagtc

SEQ ID NO: 479 - DNA, 25 bp, Homo sapiens
aatttcaaagccttcgctagtctcc

SEQ ID NO: 480 - DNA, 25 bp, Homo sapiens
atcaatgcggccaaatctagtttcc

SEQ ID NO: 481 - DNA, 25 bp, Homo sapiens
aaatttggcttctgttgtcaccttc

SEQ ID NO: 482 - DNA, 25 bp, Homo sapiens
gtaggatgtatattttcgttggatt

SEQ ID NO: 483 - DNA, 25 bp, Homo sapiens
cgaatcaaacatttaccctacacca

SEQ ID NO: 484 - DNA, 25 bp, Homo sapiens
gatgcatctgctcagactacttctc

SEQ ID NO: 485 - DNA, 25 bp, Homo sapiens
gatcaacaagctgtccgttgtggat

SEQ ID NO: 486 - DNA, 25 bp, Homo sapiens
gtaactgttcctgtggttgctttga

SEQ ID NO: 487 - DNA, 25 bp, Homo sapiens
atgtgcagacataggcggcttcctg

SEQ ID NO: 488 - DNA, 25 bp, Homo sapiens
gtggtctatgttggcgtctggatcc

SEQ ID NO: 489 - DNA, 25 bp, Homo sapiens
gaagcagccattaccaactgtacct

SEQ ID NO: 490 - DNA, 25 bp, Homo sapiens
ctgtcataatgcaggcatgaagggt

SEQ ID NO: 491 - DNA, 25 bp, Homo sapiens
gaaattcatgcttgcaccgagtaca

SEQ ID NO: 492 - DNA, 25 bp, Homo sapiens
gcttgccactgggctggatggcagc

SEQ ID NO: 493 - DNA, 25 bp, Homo sapiens
gaagttaagcagcctttctgtggag

SEQ ID NO: 494 - DNA, 25 bp, Homo sapiens
atccttgctgcagacttcgaaattg

SEQ ID NO: 495 - DNA, 25 bp, Homo sapiens
gtgctctacggaaacgtattcgaga

SEQ ID NO: 496 - DNA, 25 bp, Homo sapiens
gcaacacctgtttatgatcctggcc

SEQ ID NO: 497 - DNA, 25 bp, Homo sapiens
gcattacctcagctctaaactagcc

SEQ ID NO: 498 - DNA, 25 bp, Homo sapiens
gtctggggctcatctaaactagttc

SEQ ID NO: 499 - DNA, 25 bp, Homo sapiens
gacagtcccactctctgaaggaggg

SEQ ID NO: 500 - DNA, 25 bp, Homo sapiens
tctttgacttacgacccattttgca

SEQ ID NO: 501 - DNA, 25 bp, Homo sapiens
gaggaaatacccgtatcttcccact

SEQ ID NO: 502 - DNA, 25 bp, Homo sapiens
caaacagtgatttgtctccctcaat

SEQ ID NO: 503 - DNA, 25 bp, Homo sapiens
tcctggactgactgatactacagtg

SEQ ID NO: 504 - DNA, 25 bp, Homo sapiens
tgactccagatactgcctgagcagc

SEQ ID NO: 505 - DNA, 25 bp, Homo sapiens
caccatgtcagacgcagccgtagac

SEQ ID NO: 506 - DNA, 25 bp, Homo sapiens
ctcttttgtctgatggtagcctttc

SEQ ID NO: 507 - DNA, 25 bp, Homo sapiens
gcattcgctgtaccctttaagatat

SEQ ID NO: 508 - DNA, 25 bp, Homo sapiens
tactccctcagcatcagagcatgca

SEQ ID NO: 509 - DNA, 25 bp, Homo sapiens
tacaggagctgagagaccctaccct

SEQ ID NO: 510 - DNA, 25 bp, Homo sapiens
agagaagatcctgatgtctgcctga

SEQ ID NO: 511 - DNA, 25 bp, Homo sapiens
tagtatccagtccattgtacctgct

SEQ ID NO: 512 - DNA, 25 bp, Homo sapiens
gagctctttggcaaactggcgagtg

SEQ ID NO: 513 - DNA, 25 bp, Homo sapiens
tgtgattgaggcctgcgacgaactg

SEQ ID NO: 514 - DNA, 25 bp, Homo sapiens
gaccagcagcactgtgacgaggcta

SEQ ID NO: 515 - DNA, 25 bp, Homo sapiens
gtttgcagttacaggccagttctcc

SEQ ID NO: 516 - DNA, 25 bp, Homo sapiens
gctgctacaatacggctaatctttc

SEQ ID NO: 517 - DNA, 25 bp, Homo sapiens
ggaaggacgaggacaccgaagagca

SEQ ID NO: 518 - DNA, 25 bp, Homo sapiens
gggtacagatggatgcggcgaagtc

SEQ ID NO: 519 - DNA, 25 bp, Homo sapiens
agccctggaacttgaggagtttcag

SEQ ID NO: 520 - DNA, 25 bp, Homo sapiens
aatgggctccatgttctgtagcccc

SEQ ID NO: 521 - DNA, 25 bp, Homo sapiens
ttcttgaactggtgctgtctgggct

SEQ ID NO: 522 - DNA, 25 bp, Homo sapiens
ccatctgctgtgtttggacgcgttc

SEQ ID NO: 523 - DNA, 25 bp, Homo sapiens
tcatattgcgaaagccttggccctt

SEQ ID NO: 524 - DNA, 25 bp, Homo sapiens
gatggcgactagtggacaacagaac

SEQ ID NO: 525 - DNA, 25 bp, Homo sapiens
tcccccaggcctgtagtggtggaga

SEQ ID NO: 526 - DNA, 25 bp, Homo sapiens
tactcacctcgtcgctattaaagca

SEQ ID NO: 527 - DNA, 25 bp, Homo sapiens
tggtgcagatgaaacggcaggctct

SEQ ID NO: 528 - DNA, 25 bp, Homo sapiens
gtgaacaccatttcagagctctcag

SEQ ID NO: 529 - DNA, 25 bp, Homo sapiens
acgttcacatctgtcttgatgccta

SEQ ID NO: 530 - DNA, 25 bp, Homo sapiens
gattactttgtattgtactgccatt

SEQ ID NO: 531 - DNA, 25 bp, Homo sapiens
cagccacgtgcagcctatcaagctg

SEQ ID NO: 532 - DNA, 25 bp, Homo sapiens
gatattgtcatgaaccatcacctgc

SEQ ID NO: 533 - DNA, 25 bp, Homo sapiens
aggacccttaggagttcgatgagag

SEQ ID NO: 534 - DNA, 25 bp, Homo sapiens
taaactgtaaataacttgccctggg

SEQ ID NO: 535 - DNA, 25 bp, Homo sapiens
actgtgatataggtactctgattta

SEQ ID NO: 536 - DNA, 25 bp, Homo sapiens
tatcccaagtgctcttattctggtg

SEQ ID NO: 537 - DNA, 25 bp, Homo sapiens
cttctagccatgttgatggtggaca

SEQ ID NO: 538 - DNA, 25 bp, Homo sapiens
ggtgtgtctaagggactggctgaga

SEQ ID NO: 539 - DNA, 25 bp, Homo sapiens
acctcaggtctacctcaggactgaa

SEQ ID NO: 540 - DNA, 25 bp, Homo sapiens
aggaagatggcctctgatggacaga

SEQ ID NO: 541 - DNA, 25 bp, Homo sapiens
gagcctaactttgcaaccattggtc

SEQ ID NO: 542 - DNA, 25 bp, Homo sapiens
tggagttcgccagtcgagagcttca

SEQ ID NO: 543 - DNA, 25 bp, Homo sapiens
aatatagtgatgccatcccgtcgac

SEQ ID NO: 544 - DNA, 25 bp, Homo sapiens
gtgggcgctggggaagtacgtccca

SEQ ID NO: 545 - DNA, 25 bp, Homo sapiens
caacagcctctatgacgacatcgag

SEQ ID NO: 546 - DNA, 25 bp, Homo sapiens
atgtccttcggagttacctagcgga

SEQ ID NO: 547 - DNA, 25 bp, Homo sapiens
catcctgacaataaattccatccgt

SEQ ID NO: 548 - DNA, 25 bp, Homo sapiens
tcggagaatgacgagtggacccagg

SEQ ID NO: 549 - DNA, 25 bp, Homo sapiens
taaggaaatcagcctttcatcccgg

SEQ ID NO: 550 - DNA, 25 bp, Homo sapiens
gtctataaagcatttaacccccctg

SEQ ID NO: 551 - DNA, 25 bp, Homo sapiens
taccacttaaagaggaaccagagct

SEQ ID NO: 552 - DNA, 25 bp, Homo sapiens
gcgcagtctattaacatcacggagc

SEQ ID NO: 553 - DNA, 25 bp, Homo sapiens
cccatatcccttctgtaatttgtac

SEQ ID NO: 554 - DNA, 25 bp, Homo sapiens
aacaatgtcatttgctgctattatt

SEQ ID NO: 555 - DNA, 25 bp, Homo sapiens
gatcaagaacaatgcctccactgac

SEQ ID NO: 556 - DNA, 25 bp, Homo sapiens
gaaacacaggccatcagggaaaacg

SEQ ID NO: 557 - DNA, 25 bp, Homo sapiens
aagaccccagatgacctgcagaaac

SEQ ID NO: 558 - DNA, 25 bp, Homo sapiens
gggaatagcattgtgcgtgtccgga

SEQ ID NO: 559 - DNA, 25 bp, Homo sapiens
atctcttcattgactggtagcaacc

SEQ ID NO: 560 - DNA, 25 bp, Homo sapiens
aaaagattatttaatgcccatttca

SEQ ID NO: 561 - DNA, 25 bp, Homo sapiens
caatagtgcctatggtggtgatcaa

SEQ ID NO: 562 - DNA, 25 bp, Homo sapiens
tcactcccttgatacagcccaagat

SEQ ID NO: 563 - DNA, 25 bp, Homo sapiens
taccatcaccgcactgagatcaaca

SEQ ID NO: 564 - DNA, 25 bp, Homo sapiens
gaggcagcgggatggactacatgac

SEQ ID NO: 565 - DNA, 25 bp, Homo sapiens
tccagaagtctgtggatgccgctcc

SEQ ID NO: 566 - DNA, 25 bp, Homo sapiens
gcaagtcccgttctgttagtaggtc

SEQ ID NO: 567 - DNA, 25 bp, Homo sapiens
cagagacggcaagcacctacaggac

SEQ ID NO: 568 - DNA, 25 bp, Homo sapiens
aaagtggtggcgttttctgtactgg

SEQ ID NO: 569 - DNA, 25 bp, Homo sapiens
atgaccctaggagagctgctgaagc

SEQ ID NO: 570 - DNA, 25 bp, Homo sapiens
aggagcctccattatggcatgctga

SEQ ID NO: 571 - DNA, 25 bp, Homo sapiens
gattgtccagggtgtccatgagctc

SEQ ID NO: 572 - DNA, 25 bp, Homo sapiens
gatccagatccgaatcgaggccaac

SEQ ID NO: 573 - DNA, 25 bp, Homo sapiens
aaacatgttctagaactagttacaa

SEQ ID NO: 574 - DNA, 25 bp, Homo sapiens
ccagcccagaacactggtctcgggc

SEQ ID NO: 575 - DNA, 25 bp, Homo sapiens
acacacaccagatggcatccttggg

SEQ ID NO: 576 - DNA, 25 bp, Homo sapiens
cctccatgtcaccgcactgtagagg

SEQ ID NO: 577 - DNA, 25 bp, Homo sapiens
acctgaatctgctcagagacctggc

SEQ ID NO: 578 - DNA, 25 bp, Homo sapiens
atgggtggtttaccatttcttgagg

SEQ ID NO: 579 - DNA, 25 bp, Homo sapiens
catttcttgggatcgctcgtttggt

SEQ ID NO: 580 - DNA, 25 bp, Homo sapiens
agaacaagcgtcggaggggctgtcc

SEQ ID NO: 581 - DNA, 25 bp, Homo sapiens
aatcaagttcttgaccctattcggc

SEQ ID NO: 582 - DNA, 25 bp, Homo sapiens
tctcggctttcacttgggcagaggg

SEQ ID NO: 583 - DNA, 25 bp, Homo sapiens
agtgtgtgactcacaccttgtggct

SEQ ID NO: 584 - DNA, 25 bp, Homo sapiens
ccccctgcgaggagatcctggtgaa

SEQ ID NO: 585 - DNA, 25 bp, Homo sapiens
ggcgctgtacggcgagagtgacctc

SEQ ID NO: 586 - DNA, 25 bp, Homo sapiens
tcttccctcaatagttgccttttag

SEQ ID NO: 587 - DNA, 25 bp, Homo sapiens
gagcagcttcacagtagactgcagc

SEQ ID NO: 588 - DNA, 25 bp, Homo sapiens
aaatcccctcagaggtgtgactagt

SEQ ID NO: 589 - DNA, 25 bp, Homo sapiens
ttcggctctccaatttaactctttg

SEQ ID NO: 590 - DNA, 25 bp, Homo sapiens
tgtctcctgaagacttcccttaaaa

SEQ ID NO: 591 - DNA, 25 bp, Homo sapiens
gatgagcagacttctcggaattcat

SEQ ID NO: 592 - DNA, 25 bp, Homo sapiens
aacgtggctgtcagaatcactcctc

SEQ ID NO: 593 - DNA, 25 bp, Homo sapiens
gacattggtattctgggcagcttcc

SEQ ID NO: 594 - DNA, 25 bp, Homo sapiens
gtgccatcgtggttgagacaagtgc

SEQ ID NO: 595 - DNA, 25 bp, Homo sapiens
gaggagctgagttggcagaccgggc

SEQ ID NO: 596 - DNA, 25 bp, Homo sapiens
gagaatatacaatgatcctggaaat

SEQ ID NO: 597 - DNA, 25 bp, Homo sapiens
gccaatgaagcagcgtttcccttct

SEQ ID NO: 598 - DNA, 25 bp, Homo sapiens
cagtgactgtggttgaggacgacga

SEQ ID NO: 599 - DNA, 25 bp, Homo sapiens
cagtgttgttggcccacggggaacg

SEQ ID NO: 600 - DNA, 25 bp, Homo sapiens
aataaccacatggctaccttctatc

SEQ ID NO: 601 - DNA, 25 bp, Homo sapiens
gcattccatcccttcctgaaggggg

SEQ ID NO: 602 - DNA, 25 bp, Homo sapiens
aggagtggacaatcacctactgagg

SEQ ID NO: 603 - DNA, 25 bp, Homo sapiens
ggtgccaatttcaagttccaagttg

SEQ ID NO: 604 - DNA, 25 bp, Homo sapiens
aattttttatcatgcatgtcctgta

SEQ ID NO: 605 - DNA, 25 bp, Homo sapiens
gtgcttggagtttacctggcttatt

SEQ ID NO: 606 - DNA, 25 bp, Homo sapiens
gtgtgctatggatggcttctaacaa

SEQ ID NO: 607 - DNA, 25 bp, Homo sapiens
gcacatttgatatagctctttttct

SEQ ID NO: 608 - DNA, 25 bp, Homo sapiens
ccaagcttcatattaaccctacctg

SEQ ID NO: 609 - DNA, 25 bp, Homo sapiens
aactgttagcaagcggcatttggat

SEQ ID NO: 610 - DNA, 25 bp, Homo sapiens
agaccctgtagtccagtggtgctgc

SEQ ID NO: 611 - DNA, 25 bp, Homo sapiens
gaccccgttcagctgaagacgcagc

SEQ ID NO: 612 - DNA, 25 bp, Homo sapiens
gggaatgcaggccaagtccttttat

SEQ ID NO: 613 - DNA, 25 bp, Homo sapiens
atagctggcgagtgctttctgtatt

SEQ ID NO: 614 - DNA, 25 bp, Homo sapiens
ggacaccccaaattccagaatggct

SEQ ID NO: 615 - DNA, 25 bp, Homo sapiens
gtgtaagtgactcatcttcctgttg

SEQ ID NO: 616 - DNA, 25 bp, Homo sapiens
acatgtgcacatgcggcattttact

SEQ ID NO: 617 - DNA, 25 bp, Homo sapiens
gtggaaaagcctctaaatgcatccc

SEQ ID NO: 618 - DNA, 25 bp, Homo sapiens
aaagcaaggtttgtgctgcgcttcc

SEQ ID NO: 619 - DNA, 25 bp, Homo sapiens
accagcttgcgaataacagtccccg

SEQ ID NO: 620 - DNA, 25 bp, Homo sapiens
aatacagaactagctgccttcacaa

SEQ ID NO: 621 - DNA, 25 bp, Homo sapiens
cagcgagagcatgtccatctgttgg

SEQ ID NO: 622 - DNA, 25 bp, Homo sapiens
cacccacctgtactctggagagact

SEQ ID NO: 623 - DNA, 25 bp, Homo sapiens
gagtcgtcagaaactccagaccagt

SEQ ID NO: 624 - DNA, 25 bp, Homo sapiens
caacacagactacaggttccgcgta

SEQ ID NO: 625 - DNA, 25 bp, Homo sapiens
tcatgcgtatgcctcaggctgcaca

SEQ ID NO: 626 - DNA, 25 bp, Homo sapiens
cagaaagcgctgctgtacctgtgtg

SEQ ID NO: 627 - DNA, 25 bp, Homo sapiens
cattagtattcctcattctgcatcc

SEQ ID NO: 628 - DNA, 25 bp, Homo sapiens
aactgtactttgtaccctcacatac

SEQ ID NO: 629 - DNA, 25 bp, Homo sapiens
aacactaggggctggcccactagga

SEQ ID NO: 630 - DNA, 25 bp, Homo sapiens
caagacgcccatccggaacagggcc

SEQ ID NO: 631 - DNA, 25 bp, Homo sapiens
gggagctgggacacttaacagatgc

SEQ ID NO: 632 - DNA, 25 bp, Homo sapiens
gctgatcggctgtatgactccatga

SEQ ID NO: 633 - DNA, 25 bp, Homo sapiens
gtggcagttcagagacacgcttttc

SEQ ID NO: 634 - DNA, 25 bp, Homo sapiens
ataccgagacattgagcgactttga

SEQ ID NO: 635 - DNA, 25 bp, Homo sapiens
tttcttgaacacaggctttgtctga

SEQ ID NO: 636 - DNA, 25 bp, Homo sapiens
aagcagccctttttacagtctagtt

SEQ ID NO: 637 - DNA, 25 bp, Homo sapiens
cttgcttatatcatgtgctgccgac

SEQ ID NO: 638 - DNA, 25 bp, Homo sapiens
gatgagctatgacagcgtccaggtc

SEQ ID NO: 639 - DNA, 25 bp, Homo sapiens
ctcattacttatactgggacaccat

SEQ ID NO: 640 - DNA, 25 bp, Homo sapiens
ggtataatgtaacttcaccccagcc

SEQ ID NO: 641 - DNA, 25 bp, Homo sapiens
ggcatatggagtgtccttattgcta

SEQ ID NO: 642 - DNA, 25 bp, Homo sapiens
gtacttgcatggggttcactattta

SEQ ID NO: 643 - DNA, 25 bp, Homo sapiens
ggcttcatttcaagagtcatccagc

SEQ ID NO: 644 - DNA, 25 bp, Homo sapiens
ccccgcttggacacagtccgagtgg

SEQ ID NO: 645 - DNA, 25 bp, Homo sapiens
gtcactctgcctaaaagcactctag

SEQ ID NO: 646 - DNA, 25 bp, Homo sapiens
gctccttgcacttggaacagggctc

SEQ ID NO: 647 - DNA, 25 bp, Homo sapiens
gtcataacccacagatagatcaacc

SEQ ID NO: 648 - DNA, 25 bp, Homo sapiens
tcaaaaagaccctctggctgtggac

SEQ ID NO: 649 - DNA, 25 bp, Homo sapiens
gcgctcgagatccttcggaaagact

SEQ ID NO: 650 - DNA, 25 bp, Homo sapiens
ccaggttctcaagacacgagtcccc

SEQ ID NO: 651 - DNA, 25 bp, Homo sapiens
gaaggattcctatgtgggcgacgag

SEQ ID NO: 652 - DNA, 25 bp, Homo sapiens
tggaccctagggatttgcactaaaa

SEQ ID NO: 653 - DNA, 25 bp, Homo sapiens
gaacttaaatatatccccttcctca

SEQ ID NO: 654 - DNA, 25 bp, Homo sapiens
taccaaatcgaccagaaacctcctt

SEQ ID NO: 655 - DNA, 25 bp, Homo sapiens
gcttcgtgctgaacctgggcaaaga

SEQ ID NO: 656 - DNA, 25 bp, Homo sapiens
aagagtcagctgatgccagaaggaa

SEQ ID NO: 657 - DNA, 25 bp, Homo sapiens
gtgtaacgtgggttctgtttagcga

SEQ ID NO: 658 - DNA, 25 bp, Homo sapiens
cctgtggcccagcactggtcaagaa

SEQ ID NO: 659 - DNA, 25 bp, Homo sapiens
aacctttattccatgtgctttgctt

SEQ ID NO: 660 - DNA, 25 bp, Homo sapiens
gacttactgcggttgcgttagtttc

SEQ ID NO: 661 - DNA, 25 bp, Homo sapiens
agttctgagctgtaatttcgcctta

SEQ ID NO: 662 - DNA, 25 bp, Homo sapiens
tctcagggctgcaaccacgaggagg

SEQ ID NO: 663 - DNA, 25 bp, Homo sapiens
gtggagttgactcggtgttctgtcc

SEQ ID NO: 664 - DNA, 25 bp, Homo sapiens
ttgttcagtgactattctcggggcc

SEQ ID NO: 665 - DNA, 25 bp, Homo sapiens
aaaatggtcgctacagcatctctcg

SEQ ID NO: 666 - DNA, 25 bp, Homo sapiens
gatcagtctcaaatgggtttcttgg

SEQ ID NO: 667 - DNA, 25 bp, Homo sapiens
ttatcaagtgtcaagatcagcaagt

SEQ ID NO: 668 - DNA, 25 bp, Homo sapiens
catccttcatgagcctgcagaactg

SEQ ID NO: 669 - DNA, 25 bp, Homo sapiens
gtcttctgccattcaggtcatagcc

SEQ ID NO: 670 - DNA, 25 bp, Homo sapiens
gtgtcaacagcacattcgacagccc

SEQ ID NO: 671 - DNA, 25 bp, Homo sapiens
agcagctgaggtctcttgagggagc

SEQ ID NO: 672 - DNA, 25 bp, Homo sapiens
gatcacaccatggagactttctact

SEQ ID NO: 673 - DNA, 25 bp, Homo sapiens
gacttcctgttgtcttcatcaaagc

SEQ ID NO: 674 - DNA, 25 bp, Homo sapiens
ggagaagtatccctgctagtggctc

SEQ ID NO: 675 - DNA, 25 bp, Homo sapiens
gttacaggcggtgtccttttaaatg

SEQ ID NO: 676 - DNA, 25 bp, Homo sapiens
ggaattgtgagctggggccgtggat

SEQ ID NO: 677 - DNA, 25 bp, Homo sapiens
ccaccgctctcatttcatggagtct

SEQ ID NO: 678 - DNA, 25 bp, Homo sapiens
ctttggggcaagctattccagcact

SEQ ID NO: 679 - DNA, 25 bp, Homo sapiens
cctactgtggtactgaagacttctg

SEQ ID NO: 680 - DNA, 25 bp, Homo sapiens
gaaatggtttcacttgctctttgac

SEQ ID NO: 681 - DNA, 25 bp, Homo sapiens
agggaccggtgctgcaggagtgtcc

SEQ ID NO: 682 - DNA, 25 bp, Homo sapiens
tatttaagtggagcccctacgtaga

SEQ ID NO: 683 - DNA, 25 bp, Homo sapiens
ggtaattaatccattcctggcataa

SEQ ID NO: 684 - DNA, 25 bp, Homo sapiens
gtggagttcctacatgcagtgagtg

SEQ ID NO: 685 - DNA, 25 bp, Homo sapiens
agtaatcagtcaatccaatatcccc

SEQ ID NO: 686 - DNA, 25 bp, Homo sapiens
gacgaggcttttgagcagctggtgc

SEQ ID NO: 687 - DNA, 25 bp, Homo sapiens
ggtaggatatcttggctttgccaca

SEQ ID NO: 688 - DNA, 25 bp, Homo sapiens
ctgaacggaacagtgtccccacaga

SEQ ID NO: 689 - DNA, 25 bp, Homo sapiens
gcgtgccgagctgaggcagatgttc

SEQ ID NO: 690 - DNA, 25 bp, Homo sapiens
gggtggtaatattggcattctgatt

SEQ ID NO: 691 - DNA, 25 bp, Homo sapiens
aatgctttccatctccaggagactt

SEQ ID NO: 692 - DNA, 25 bp, Homo sapiens
gacagagatcactcgctattccttc

SEQ ID NO: 693 - DNA, 25 bp, Homo sapiens
ataggaagtatgtttgtttcttagt

SEQ ID NO: 694 - DNA, 25 bp, Homo sapiens
ggaatattccgattcattcctgccc

SEQ ID NO: 695 - DNA, 25 bp, Homo sapiens
tgtggatcggatattccttcctcat

SEQ ID NO: 696 - DNA, 25 bp, Homo sapiens
ggcaaggaaagatccctttgctcta

SEQ ID NO: 697 - DNA, 25 bp, Homo sapiens
gactgagcggtgcattgagtccctg

SEQ ID NO: 698 - DNA, 25 bp, Homo sapiens
accagtgcccaaagtctgtgtgatg

SEQ ID NO: 699 - DNA, 25 bp, Homo sapiens
gaactacgcttgctcattttttctt

SEQ ID NO: 700 - DNA, 25 bp, Homo sapiens
taaccttggctatgttaccaccgtt

SEQ ID NO: 701 - DNA, 25 bp, Homo sapiens
taatgaccaacctgtttctacctat

SEQ ID NO: 702 - DNA, 25 bp, Homo sapiens
tgcacgaagatataatgtccacatt

SEQ ID NO: 703 - DNA, 25 bp, Homo sapiens
cagacggaggtcaggtcttcctctt

SEQ ID NO: 704 - DNA, 25 bp, Homo sapiens
gacaaaactagttcactcactgctt

SEQ ID NO: 705 - DNA, 25 bp, Homo sapiens
ggctggaaatggtttcacttgctct

SEQ ID NO: 706 - DNA, 25 bp, Homo sapiens
agcacaagcttatgcttcccgtagc

SEQ ID NO: 707 - DNA, 25 bp, Homo sapiens
ctttgtcaatctatggacatgccca

SEQ ID NO: 708 - DNA, 25 bp, Homo sapiens
tgccatcttcgctttgctggaaatg

SEQ ID NO: 709 - DNA, 25 bp, Homo sapiens
cagaaagcgctgctgtacctgtgtg

SEQ ID NO: 710 - DNA, 25 bp, Homo sapiens
agtccaaatcgcaggcatatgctat

SEQ ID NO: 711 - DNA, 25 bp, Homo sapiens
agacaaccacgtggtgcctgtactg

SEQ ID NO: 712 - DNA, 25 bp, Homo sapiens
gaatcactattcctggttatctcac

SEQ ID NO: 713 - DNA, 25 bp, Homo sapiens
gtgggcaccaatctacaactatgtc

SEQ ID NO: 714 - DNA, 25 bp, Homo sapiens
agggcagctgctatttattttccta

SEQ ID NO: 715 - DNA, 25 bp, Homo sapiens
tctcctctggacctaaacctgaaat

SEQ ID NO: 716 - DNA, 25 bp, Homo sapiens
gaactcttgccctggaataatcttg

SEQ ID NO: 717 - DNA, 25 bp, Homo sapiens
agctgtggctgcaggaacttaattt

SEQ ID NO: 718 - DNA, 25 bp, Homo sapiens
tcacagcgggcaggacggaccccgc

SEQ ID NO: 719 - DNA, 25 bp, Homo sapiens
gccccagtttgtaaatgaacctgtg

SEQ ID NO: 720 - DNA, 25 bp, Homo sapiens
tggcatttaggcagcagagcccctg

SEQ ID NO: 721 - DNA, 25 bp, Homo sapiens
ttttttctctggtggcattccttta

SEQ ID NO: 722 - DNA, 25 bp, Homo sapiens
tcaagtgtgtacaacagtcccatga

SEQ ID NO: 723 - DNA, 25 bp, Homo sapiens
cctgatactgtagttcactgtagaa

SEQ ID NO: 724 - DNA, 25 bp, Homo sapiens
tcttcacagtgttcccctagaaagg

SEQ ID NO: 725 - DNA, 25 bp, Homo sapiens
agattctaacggtctgttctgtttc

SEQ ID NO: 726 - DNA, 25 bp, Homo sapiens
gcgttgcagcaatcagtgttaaatc

SEQ ID NO: 727 - DNA, 25 bp, Homo sapiens
gagcattgcttacaggttttttgtt

SEQ ID NO: 728 - DNA, 25 bp, Homo sapiens
gtctgagggtcttcctttatgcttg

SEQ ID NO: 729 - DNA, 25 bp, Homo sapiens
aatcgtgtgtccgtggaaccagtcc

SEQ ID NO: 730 - DNA, 25 bp, Homo sapiens
tgctttttgatctcttcgactaaaa

SEQ ID NO: 731 - DNA, 25 bp, Homo sapiens
gaagtatggctttttatgcatcctt

SEQ ID NO: 732 - DNA, 25 bp, Homo sapiens
atatgctttacactagctttctgca

SEQ ID NO: 733 - DNA, 25 bp, Homo sapiens
agtgacaaacattctctcatcctac

SEQ ID NO: 734 - DNA, 25 bp, Homo sapiens
aaactgcgttaaaggctcgattttg

SEQ ID NO: 735 - DNA, 25 bp, Homo sapiens
gtggcctgaagagccagagctagct

SEQ ID NO: 736 - DNA, 25 bp, Homo sapiens
aatgatcaccatgttagccttagac

SEQ ID NO: 737 - DNA, 25 bp, Homo sapiens
ttttcactcagttttggttccctgc

SEQ ID NO: 738 - DNA, 25 bp, Homo sapiens
gaccgtgagttcctagagcttggct

SEQ ID NO: 739 - DNA, 25 bp, Homo sapiens
atccgatgatagtactgcagttttc

SEQ ID NO: 740 - DNA, 25 bp, Homo sapiens
ctcacccaggcaatcttgccttctg

SEQ ID NO: 741 - DNA, 25 bp, Homo sapiens
agcagttaacatctgaagtgtctaa

SEQ ID NO: 742 - DNA, 25 bp, Homo sapiens
aaatcttgatatccagaagcacatg

SEQ ID NO: 743 - DNA, 25 bp, Homo sapiens
gacacaatgagcttagtacctccaa

SEQ ID NO: 744 - DNA, 25 bp, Homo sapiens
ctctcctaatactccacattcaaac

SEQ ID NO: 745 - DNA, 25 bp, Homo sapiens
tcccgcagcagttcctgaatggggt

SEQ ID NO: 746 - DNA, 25 bp, Homo sapiens
aggggatttgcttccttgttatgta

SEQ ID NO: 747 - DNA, 25 bp, Homo sapiens
cgcaagtctgagggtctgggcggcg

SEQ ID NO: 748 - DNA, 25 bp, Homo sapiens
aatgtgatactgtctctttgaagca

SEQ ID NO: 749 - DNA, 25 bp, Homo sapiens
ctgacccaggacccaacatggtcta

SEQ ID NO: 750 - DNA, 25 bp, Homo sapiens
tctacatactaaatctctctccttt

SEQ ID NO: 751 - DNA, 25 bp, Homo sapiens
ttgatgctcatatctgttcttcagc

SEQ ID NO: 752 - DNA, 25 bp, Homo sapiens
attgctccactgttcaccaaggaag

SEQ ID NO: 753 - DNA, 25 bp, Homo sapiens
tcccacctcactggatcttgatgtt

SEQ ID NO: 754 - DNA, 25 bp, Homo sapiens
cccgactcctgctgcattaatgtta

SEQ ID NO: 755 - DNA, 25 bp, Homo sapiens
aaatatgttgattcatggctataat

SEQ ID NO: 756 - DNA, 25 bp, Homo sapiens
gatggtacagatgttcctgccttag

SEQ ID NO: 757 - DNA, 25 bp, Homo sapiens
atgacagtttcacaacctgcattga

SEQ ID NO: 758 - DNA, 25 bp, Homo sapiens
aagctcacatctaaacagcctgtag

SEQ ID NO: 759 - DNA, 25 bp, Homo sapiens
ttaccccatttaattctagagtcta

SEQ ID NO: 760 - DNA, 25 bp, Homo sapiens
tagaggcgcctagaaattccacttg

SEQ ID NO: 761 - DNA, 25 bp, Homo sapiens
agggcaacgctagacacagaatccg

SEQ ID NO: 762 - DNA, 25 bp, Homo sapiens
gtgagacccataccattgcaatgat

SEQ ID NO: 763 - DNA, 25 bp, Homo sapiens
ggaacgtggaaccttcagatctaaa

SEQ ID NO: 764 - DNA, 25 bp, Homo sapiens
cacttcttttttcctatgcactggt

SEQ ID NO: 765 - DNA, 25 bp, Homo sapiens
gcaccatcccagtgatgttctggca

SEQ ID NO: 766 - DNA, 25 bp, Homo sapiens
gccgttgttcagttctaatcacact

SEQ ID NO: 767 - DNA, 25 bp, Homo sapiens
agctctgccaccaatatgtatcttc

SEQ ID NO: 768 - DNA, 25 bp, Homo sapiens
caggtggaggtgtcaggctgctggc

SEQ ID NO: 769 - DNA, 25 bp, Homo sapiens
gtcaaagcaaccatacttcacctag

SEQ ID NO: 770 - DNA, 25 bp, Homo sapiens
gccagcgtctagttagccctggctc

SEQ ID NO: 771 - DNA, 25 bp, Homo sapiens
actgctagagcccagacctgagtga

SEQ ID NO: 772 - DNA, 25 bp, Homo sapiens
ctacggtcatgttcagcttcattgc

SEQ ID NO: 773 - DNA, 25 bp, Homo sapiens
caggcatctgaaaaccttatctgct

SEQ ID NO: 774 - DNA, 25 bp, Homo sapiens
ggagtccaagcttgtgctctttggc

SEQ ID NO: 775 - DNA, 25 bp, Homo sapiens
acatcaatcgtgtgtcctgatttgg

SEQ ID NO: 776 - DNA, 25 bp, Homo sapiens
agtgcctgaggacctttgctgtgtc

SEQ ID NO: 777 - DNA, 25 bp, Homo sapiens
tgggggggaggtgaggtaccagcct

SEQ ID NO: 778 - DNA, 25 bp, Homo sapiens
tcggcactacttctattcagcattg

SEQ ID NO: 779 - DNA, 25 bp, Homo sapiens
ccttctactgaacctttgaggaaag

SEQ ID NO: 780 - DNA, 25 bp, Homo sapiens
gcatctggccaatgagtctgctgag

SEQ ID NO: 781 - DNA, 25 bp, Homo sapiens
gatctgtaatgttatttccacttat

SEQ ID NO: 782 - DNA, 25 bp, Homo sapiens
tggtaggattcccaggtcagcagca

SEQ ID NO: 783 - DNA, 25 bp, Homo sapiens
tgcccagcagctcttggtcaaagca

SEQ ID NO: 784 - DNA, 25 bp, Homo sapiens
gaagccaggaatttcccaggacctg

SEQ ID NO: 785 - DNA, 25 bp, Homo sapiens
ataaaagctaggcgtgtttgatgcg

SEQ ID NO: 786 - DNA, 25 bp, Homo sapiens
gccgctgggcctttttaattgccaa

SEQ ID NO: 787 - DNA, 25 bp, Homo sapiens
atgtgactcagtctgttccactgta

SEQ ID NO: 788 - DNA, 25 bp, Homo sapiens
ggtgctatgcttctgttattattcc

SEQ ID NO: 789 - DNA, 25 bp, Homo sapiens
gaccaccttataccagcgttatgag

SEQ ID NO: 790 - DNA, 25 bp, Homo sapiens
tcacgggcaacgacagtctgcacga

SEQ ID NO: 791 - DNA, 25 bp, Homo sapiens
gaatttcgcaccctgacgattactc

SEQ ID NO: 792 - DNA, 25 bp, Homo sapiens
acatcccctcagttgcagtgaattg

SEQ ID NO: 793 - DNA, 25 bp, Homo sapiens
ggactgtcactgtggacgccaaaat

SEQ ID NO: 794 - DNA, 25 bp, Homo sapiens
ggtcaagggcaagtcaaagcaacta

SEQ ID NO: 795 - DNA, 25 bp, Homo sapiens
tttttaccttgactacctgaattgc

SEQ ID NO: 796 - DNA, 25 bp, Homo sapiens
cgtgagatgctcacgagtacccttc

SEQ ID NO: 797 - DNA, 25 bp, Homo sapiens
ccagccctgtgtgtgaatcgtttgt

SEQ ID NO: 798 - DNA, 25 bp, Homo sapiens
gacactctctaccaagagggtcttc

SEQ ID NO: 799 - DNA, 25 bp, Homo sapiens
agaggctcgagagcaggccatttcc

SEQ ID NO: 800 - DNA, 25 bp, Homo sapiens
gtgacttaggcaggagtcgacctcc

SEQ ID NO: 801 - DNA, 25 bp, Homo sapiens
tatcagattctttcttttcgacttt

SEQ ID NO: 802 - DNA, 25 bp, Homo sapiens
caagattaccttcctgttttagcct

SEQ ID NO: 803 - DNA, 25 bp, Homo sapiens
tgtggatgtttccaagcctgacctc

SEQ ID NO: 804 - DNA, 25 bp, Homo sapiens
gtgcgctgtctgtctgagcagagcg

SEQ ID NO: 805 - DNA, 25 bp, Homo sapiens
ttattgaccttccatggtcctcact

SEQ ID NO: 806 - DNA, 25 bp, Homo sapiens
gttgacaggtttgcttgggacgcta

SEQ ID NO: 807 - DNA, 25 bp, Homo sapiens
acggatgggtctcagttacaaataa

SEQ ID NO: 808 - DNA, 25 bp, Homo sapiens
aggtgcttattctcaaagcaggaat

SEQ ID NO: 809 - DNA, 25 bp, Homo sapiens
gacaactgcgtgggtccaaacactc

SEQ ID NO: 810 - DNA, 25 bp, Homo sapiens
gctgtgttggtagtgctgtgttgaa

SEQ ID NO: 811 - DNA, 25 bp, Homo sapiens
tatcgtttttaggtttggtatgtgt

SEQ ID NO: 812 - DNA, 25 bp, Homo sapiens
gcatttccacatatccacaaacaca

SEQ ID NO: 813 - DNA, 25 bp, Homo sapiens
aaggtcatggatgtgcacgatggca

SEQ ID NO: 814 - DNA, 25 bp, Homo sapiens
gagtcattctcatgcttttctttat

SEQ ID NO: 815 - DNA, 25 bp, Homo sapiens
ggactgcaaattgagtttctttctc

SEQ ID NO: 816 - DNA, 25 bp, Homo sapiens
ctcagtgcattcgtgtgctcgcacg

SEQ ID NO: 817 - DNA, 25 bp, Homo sapiens
ggacctttctaccagttgtggacca

SEQ ID NO: 818 - DNA, 25 bp, Homo sapiens
ctggtcctgtacgacatttactggt

SEQ ID NO: 819 - DNA, 25 bp, Homo sapiens
gagtaacttcttaaatccctgttct

SEQ ID NO: 820 - DNA, 25 bp, Homo sapiens
gtgctcagtcgtacgacctgtacct

SEQ ID NO: 821 - DNA, 25 bp, Homo sapiens
cagggctgtcatcaacatggatatg

SEQ ID NO: 822 - DNA, 25 bp, Homo sapiens
gtgaaggtggccgtgtgtgacatcc

SEQ ID NO: 823 - DNA, 25 bp, Homo sapiens
tgaagggggcaagcaagacctctcc

SEQ ID NO: 824 - DNA, 25 bp, Homo sapiens
agtgacatgggacactccttttctg

SEQ ID NO: 825 - DNA, 25 bp, Homo sapiens
agagcatgctctgcgttgttggttt

SEQ ID NO: 826 - DNA, 25 bp, Homo sapiens
atatttacgtattctccaaagcagt

SEQ ID NO: 827 - DNA, 535 bp, Homo sapiens
tgatatcgccgcgctcgtcgtcgacaacggctccggcatgtgcaaggccggcttcgcgggcgacgatgccccccgggccgtcttcccctccatcgtggggcgccccaggcaccagggcgtgatggtgggcatgggtcagaaggattcctatgtgggcgacgaggcccagagcaagagaggcatcctcaccctgaagtaccccatcgagcacggcatcgtcaccaactgggacgacatggagaaaatctggcaccacaccttctacaatgagctgcgtgtggctcccgaggagcaccccgtgctgctgaccgaggcccccctgaaccccaaggccaaccgcgagaagatgacccagatcatgtttgagaccttcaacaccccagccatgtacgttgctatccaggctgtgctatccctgtacgcctctggccgtaccactggcatcgtgatggactccggtgacggggtcacccacactgtgcccatctacgaggggtatgccctcccccatgccatcctgcgtctggacctggct

SEQ ID NO: 828 - DNA, 529 bp, Homo sapiens
accacggccgagcgggaaatcgtgcgtgacattaaggagaagctgtgctacgtcgccctggacttcgagcaagagatggccacggctgcttccagctcctccctggagaagagctacgagctgcctgacggccaggtcatcaccattggcaatgagcggttccgctgccctgaggcactcttccagccttccttcctgggcatggagtcctgtggcatccacgaaactaccttcaactccatcatgaagtgtgacgtggacatccgcaaagacctgtacgccaacacagtgctgtctggcggcaccaccatgtaccctggcattgccgacaggatgcagaaggagatcactgccctggcacccagcacaatgaagatcaagatcattgctcctcctgagcgcaagtactccgtgtggatcggcggctccatcctggcctcgctgtccaccttccagcagatgtggatcagcaagcaggagtatgacgagtccggcccctccatcgtccaccgcaaatgcttctaggcgg

SEQ ID NO: 829 - DNA, 538 bp, Homo sapiens
tcttgacaaaacctaacttgcgcagaaaacaagatgagattggcatggctttatttgttttttttgttttgttttggttttttttttttttttggcttgactcaggatttaaaaactggaacggtgaaggtgacagcagtcggttggagcgagcatcccccaaagttcacaatgtggccgaggactttgattgcacattgttgtttttttaatagtcattccaaatatgagatgcattgttacaggaagtcccttgccatcctaaaagccaccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttccccctttttgtcccccaacttgagatgtatgaaggcttttggtctccctgggagtgggtggaggcagccagggcttacctgtacactgacttgagacca

SEQ ID NO: 830 - DNA, 514 bp, Homo sapiens
aactcgaggactgtatttgtgactaattgtataacaggttattttagtttctgttctgtggaaagtgtaaagcattccaacaaagggttttaatgtagatttttttttttgcaccccatgctgttgattgctaaatgtaacagtctgatcgtgacgctgaataaatgtcttttttttaatgtgctgtgtaaagttagtctactcttaagccatcttggtaaatttccccaacagtgtgaagttagaattccttcagggtgatgccaggttctatttggaatttatatacaacctgcttgggtggagaagccattgtcttcggaaaccttggtgtagttgaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgt

SEQ ID NO: 831 - DNA, 324 bp, Homo sapiens
cagcttgaagaactatgatccccagaaggacaagcgcttctcgggcaccgtcaggcttaagtccactccccgccctaagttctctgtgtgtgtcctgggggaccagcagcactgtgacgaggctaaggccgtggatatcccccacatggacatcgaggcgctgaaaaaactcaacaagaataaaaaactggtcaagaagctggtcaagaagtatgatgcgtttttggcctcagagtctctgatcaagcagattccacgaatcctcggcccaggtttaaataaggcaggaaagttcccttccctgctcacacacaacgaaaacat

SEQ ID NO: 832 - DNA, 526 bp, Homo sapiens
cagggaaaagtgaggctcttgggggtggtttgaccctgcttacctgggagcacacttttcccttccccgatgacctgggatggtggccaggccgtgcccttgctgttgctgggcagtgtccttttggaaagggagctgccccaggctttagtgcagctgccaaccctgttaggcctggcctctcgaggcctcttctgatctcaagggtcacaccccctcaaagatcctctcacccatggtagttgctgctcgtggttctgtctgtccgtgcaccgatgcacacaccgcaccccaccactgtactctgaaattggcgagtgagtggagagccagctctgcggagtcatcacgcagccatggttgtgcctgccgttcatggtggtctttcaggttatcttggcaacatgtacattgcttttattttttttcttttttgctttcattgtacagtcagtactataaaatttctcttttgagttttatacctttgtagcattttagatgacattgtgtttgtactttgttg

SEQ ID NO: 833 - DNA, 478 bp, Homo sapiens
aatagacttgtgtcttcaccttgctgcattgtgaccagcacctacggctggacagccaatatggagcggatcatgaaagcccaggcacttcgggacaactccaccatgggctatatgatggccaaaaagcacctggagatcaaccctgaccaccccattgtggagacgctgcggcagaaggctgaggccgacaagaatgataaggcagttaaggacctggtggtgctgctgtttgaaaccgccctgctatcttctggcttttcccttgaggatccccagacccactccaaccgcatctatcgcatgatcaagctaggtctaggtattgatgaagatgaagtggcagcagaggaacccaatgctgcagttcctgatgagatcccccctctcgagggcgatgaggatgcgtctcgcatggaagaagtcgattaggttaggagttcatagttggaaaacttgtgcccttgtatagtgtccc

SEQ ID NO: 834 - DNA, 472 bp, Homo sapiens
acttcgtactttctatgagaagcgtatggccacagaagttgctgctgacgctctgggtgaagaatggaagggttatgtggtccgaatcagtggtgggaacgacaaacaaggtttccccatgaagcagggtgtcttgacccatggccgtgtccgcctgctactgagtaaggggcattcctgttacagaccaaggagaactggagaaagaaagagaaaatcagttcgtggttgcattgtggatgcaaatctgagcgttctcaacttggttattgtaaaaaaaggagagaaggatattcctggactgactgatactacagtgcctcgccgcctgggccccaaaagagctagcagaatccgcaaacttttcaatctctctaaagaagatgatgtccgccagtatgttgtaagaaagcccttaaataaagaaggtaagaaacctaggaccaaagcacccaagattcagcgtcttgtt

SEQ ID NO: 835 - DNA, 257 bp, Homo sapiens
ctgttgttgatgtaatttgtgactcttcttaatggaagatgacaggattgtaaaaggtatgctaggggactgatcttctctgctggatcagtcagtcagctgttactagttgatgctgtgctaacatgatcccctcctacttccatgttgctcttactacaaaggttatcatttgcatttatgtccatggtaggctgagctataatatgctggctttgcagcagaatgaaaaggatgagttggtgtagccttataag

SEQ ID NO: 836 - DNA, 178 bp, Homo sapiens
tgctgagcggcttatgttctgaatttgtttatgagaactgatcattagtgagactggccacagtatttaaccttgcacatgcatgctcagtgaagcctagacattcagagcagcagaaataaagtaacttatttttctttccaccttgcctgagactggcattttagagacctgttaa

SEQ ID NO: 837 - DNA, 274 bp, Homo sapiens
atgacctggtgcaggcactgggactaagcaagggtcctggcctggaggtgtgaaggtgctgtatcccggaaatctatctggaccctggactgcagtgcaggagatgacagagtgaggagggcccagagcagaattctggccccagaactctgtgcccaggagccatgccttgagcagtattagccgtgtgtgtatgcatgtgagtgtgtgtgtatgtgtgtgtgtgcatgcatatgcatgtgcatgtgtgtgagctccttgaacgcacggagca

SEQ ID NO: 838 - DNA, 258 bp, Homo sapiens
gtgcaaagggcttagctaagttatcgagcttaaaacccgtcaattaaacaaacattatttgaacagttactgcatgccacgcactgtgttgggcttagtaataaaaaaaagaaaagataagtgcttgttctagcataaattaaaaggtccaagggaatttaatctggaagagaacatatgccaatttttaaactatgacagcttttttttttctctttccattcaaatagtcctggttcattcccagaagggcacaaa

SEQ ID NO: 839 - DNA, 281 bp, Homo sapiens
ttggctgcagttaggacctcagtggctggtatggccgagctgctagaagatgctgctgtccctgtgatcccagcagccctcccttcaccgtgacccctgacctttgtcaggaaggtgcagtttttcttctcaatctaaatgcctttcaggtgggccgcttccttggctacctggttccagggggctgttttgtaatgagatgctgctggcaggccactcagaggctcccagctgggttggtgggacagccaggccagatgacctgattccagcaaaaataa

SEQ ID NO: 840 - DNA, 245 bp, Homo sapiens
ccctggcgcgcgtctttggagagctggcggtgcacggcgcagagcacggcgtggaggacttttccgtgagccagacgatgctggaggaggtattcttgtacttctccaaggaccaggggaaggacgaggacaccgaagagcagaaggaggcaggagtgggagtggaccccgcgccaggcctgcagcaccccaaacgcgtcagccagttcctcgatgaccctagcactgccgagactgtgctctga

SEQ ID NO: 841 - DNA, 289 bp, Homo sapiens
agccggcccgcctgagagacactaggggaaatagcttttgtgggcaagcagggtggccggtggtgctcagcagtctttccagtggctgtgtccctcctccaaatgtggacaggccatgacagagtcttagcccaagtcccacagatccccaaaagttctgttgattgcttcaggggatcagtgaaaattagggaattttgtgtgttgctatatacattttttctggggagatgagcttctcattgagatctgtgactcagaatcgactaagccaccataagtctggatt

SEQ ID NO: 842 - DNA, 296 bp, Homo sapiens
gggcagaaaagccatgtcgccatttacttgacacctttcagtgccacacacacccttctgcccctcccctgcctagtccagggcttcacactgagccttcctatgacaataggggccgaactgccactggtttctgaggcctcagtgtaaagggcaaatgcgacaccaattccaacaaacctgtaaatgtcaatggctaagtagtaaaagtttctgcagaggccccagagctgggattgattcagttccacctcaggttttttcctgagtgagagggagagacgtaactttggaat

SEQ ID NO: 843 - DNA, 163 bp, Homo sapiens
agaagaagttaacaagtgacctggggcgcgccgccacgagactgcaggagcttctgaagacgacccaggagcagctggcaagggagaaggacacggtgaagaagctgcaggaacagctggaaaaggcagaggacggcagcagctcaaaggagggcacctctgt

SEQ ID NO: 844 - DNA, 258 bp, Homo sapiens
gcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcata

SEQ ID NO: 845 - DNA, 150 bp, Homo sapiens
cattgacgtggcctgcgatctcagtgacaatgatctgctttctggatctcactgttgcctttggttagggaacacagagtgcttctcccgcagccctactggaacacagcagagtctgtgccatgaagcagttacagaaacagaattgat

SEQ ID NO: 846 - DNA, 191 bp, Homo sapiens
gaagcttgagatctatctcaccgacgaagacttcgagtttgcactagacatgacgagggatgaatacaacgccctgcccgcctggaagcaggtgaacctgaagaaagcaaaaggcctgttctgagtggggagacgccagaggagcctcacggtcacgtccaacaacaccactgcaccagggaaatggatat

SEQ ID NO: 847 - DNA, 277 bp, Homo sapiens
gtgtgtcagatggagagatccccttaacctaagagccttaaatagccctgaaagtacactgggacggtttgcgatggaattaaaattggaagtgaatatttttaggtgctcttgaagctttctggggactcaaaattatcaaaagtcagggacagtccggaggaagagcgtctgcaaaactgggttcctagaagtatagacggacttagctttttgtagaatttggtgaggagcagcgcctcgtgagagcagaatggcctggcgtggccagtgcttc

SEQ ID NO: 848 - DNA, 187 bp, Homo sapiens
aatttcttggtctccgaaaactcagctgtgactgctttccattaacagttccagctctatgtgtttcctctaacgctaaaggcacagcccccgggaatctactgcttcctaagagtctccatggagtctattttacaacctcctttccctccatgcttccgcggaggagtctatactatctctatat

SEQ ID NO: 849 - DNA, 95 bp, Homo sapiens
tgtcccggaaccacatgcacgaaatgagccagaagtgagcgctgggaacagagtggagtctccggtgtgtacctcagactgatggtgcccatgtg

SEQ ID NO: 850 - DNA, 272 bp, Homo sapiens
gactgtgaggtgttcgagtcacgcttccccaccaccatggccttgtccgtgctcgtgaccattgaaatgtgcaatgccctcaacagcgtctcggagaaccagtcgctgctgcggatgccgccctggatgaacccctggctgctggtggctgtggccatgtccatggccctgcacttcctcatcctgctcgtgccgcccctgcctctcattttccaggtgaccccactgagcgggcgccagtgggtggtggtgctccagatatctctgcctgt

SEQ ID NO: 851 - DNA, 138 bp, Homo sapiens
cctgttgaggtgtgaaatgccccgtcagaaattaaatacaaacttaaatgtgcctattggtgtctaaacttcatacaatgtaaggtcagattccttttaggaatactgggtgctgtcaccaggtttgatagttagact

SEQ ID NO: 852 - DNA, 266 bp, Homo sapiens
actgtggctagttgtctgtccggtggctgggagggggtgtggtgggaaaaagtcggaatctctgcaatctgtgtcatggactgtactattgtaaggtctatattctgtatgtgggtcccagaccctgatcaggaaatgagcctcatgtgtgtcgttaacatttatatatttccattcaaaatatgtattcagtgtttatttcctcaaaacagactttgttaatgtaggaaatctctccaagtggaaacgtgctaactttttctgta

SEQ ID NO: 853 - DNA, 294 bp, Homo sapiens
caagctatagttaatgcctccaggctgcctatgtccatcataattgttggagttggaggtgctgacttcagcgccatggagtttctggatggtgatggtggaagtctccgctccccattgggcgaagtggccatcagagatattgtccagtttgtgcctttcagacagttccagaatgctccaaaagaagcacttgctcagtgtgtcttggcagagattccccagcaggtggtgggctacttcaatacatacaaactccttcctcccaagaacccagccacgaaacaacagaag

SEQ ID NO: 854 - DNA, 66 bp, Homo sapiens
tttattcctttagtagagcaaattcttatttttttcgccttcactggtaacagcttttgtgggagc

SEQ ID NO: 855 - DNA, 160 bp, Homo sapiens
accagtcaagttggatttgaacccagctgctctgtactgcacttagaatgatgtaatattccaggatgctgctgcaggtggcgtatcatcgtacacactcagtgacatttctatcacaatcattttatggaagatgtgtgataatctgtttttactggta

SEQ ID NO: 856 - DNA, 35 bp, Homo sapiens
gattgttaccataaattagtgctaatgctgaggag

SEQ ID NO: 857 - DNA, 232 bp, Homo sapiens
tggattacaaaacctcgagcccttctcagtagtggtgctgtattgtacaaagcgtgttctgtaatatttcctctaatttactcagaaatgaagtatatggttcattaagcttaaaggggaaccatttgtgaatgaatatttggaacttaccaagtcctaagagacttttggaagaggatatatatagcatagtaccataccacttataaagtggaaactcttggaccaagat

SEQ ID NO: 858 - DNA, 250 bp, Homo sapiens
gaaacttgtcagaaggcataggagttgtgcgagggctggatgggaagtctagatttaaacagccaccaggcagcttatcaaagcaagagggcatccgttcacaggacaggggctcccagcaattcccagtggcagtggggggtggctggcccaagccccaagtcacccagacacaggggacttccccttgtgtcaacagcatgctagggcccagcaaactagagggtaggtaggaccaccttggcaccaa

SEQ ID NO: 859 - DNA, 129 bp, Homo sapiens
tatgccatatataatatcccagagggatctgctataatattgcataatcgaattcatatttctgcagcaaaatgtgtggatactctcacaaggcaggataaatagagactatatatactgggccaggtg

SEQ ID NO: 860 - DNA, 180 bp, Homo sapiens
tgatgccatatcagatggttttagaattctgcactttaataatgtaatgcatatgccatatataatatcccagagggatctgctataatattgcataatcgaattcatatttctgcagcaaaatgtgtggatactctcacaaggcaggataaatagagactatatatactgggccaggtg

SEQ ID NO: 861 - DNA, 260 bp, Homo sapiens
agttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaat

SEQ ID NO: 862 - DNA, 205 bp, Homo sapiens
aacttcgaccatccccagaaagagatgccctcattcagctttcagaaattgtactcacaagagataaatgacaactctttctgttctttctggcagctatcttaccagactgtgcctaaagaattttgtggaatacactttgtttgcttcatgtgcagataaccaaaaatcattttaaaagatatcaaacttattgatgggcaat

SEQ ID NO: 863 - DNA, 119 bp, Homo sapiens
tgggaatttttgtacaatgaatttacatttatttatggtgacatatttacgcttgtgatcaaataatgatgttaaattcttaaatcatatttgctatgcagctgaagatgatattttga

SEQ ID NO: 864 - DNA, 234 bp, Homo sapiens
tttcagaaactgtcaaatgtaccatatttgtattaagagttgttgggaatttttgtacaatgaatttacatttatttatggtgacatatttacgcttgtgatcaaataatgatgttaaattcttaaatcatatttgctatgcagctgaagatgatattttgatttgtattttgggggtacctgtgttgagttgataaacatttccatcttcattaaaactgcttccaaactaaa

SEQ ID NO: 865 - DNA, 142 bp, Homo sapiens
ggttcattttagtttcagatagatggcttcaccaaagaactcttgaaagaatactgattagggaggggcagggaagtaggagcttatggtatattataaggctgggaaaaatctatgatgcaaaccctttccacatagtact

SEQ ID NO: 866 - DNA, 184 bp, Homo sapiens
agctggccctaccataatgcctttgatcagacaaatacagaccgctgtcatgccaaacggaactcctcacccaactgctgcaatagttcctccagggcccgaagctggtttaatctatacaccctatgagtacccctacacattggcaccagctacatcaatccttgagtatcctattgaacct

SEQ ID NO: 867 - DNA, 194 bp, Homo sapiens
  misc_feature (97)..(97): n is a, c, g, or t
ctcagggaatatttaattctggttttagcattattagaataagactttatacattaactaaagtggagctttaatcactataaaaagcaaaagtatntatagacacagacacttgcctatacagagacataaccacacacactcagaggatagtgaacaaatctgtctttgacttacgacccattttgcaagac

SEQ ID NO: 868 - DNA, 253 bp, Homo sapiens
gacttctgagtacagttaagttcctcctatttgccactgggctgttggttagaagcataggtaactgattaagtaggtatgatactgcatttgaaataagtggacacaaactatcctttctccaccatggactcaatctgagaacaacagcattcatttccattcatttccatactggcttttgattatatgcagattcctagtagcatgccttacctacagcactatgtgcatttgctgtcacaataaagta

SEQ ID NO: 869 - DNA, 259 bp, Homo sapiens
actaatgataatccatctcccttcgctgactctcttttcggactcagcccgcctgcatccaggtgaaataaacagccgtgttgctcacacaaagcctgtttggtggtctcttcacacggacgcacatgaaatttggtgccgtgactcggatcgggggacctcccttgggagatcaatccccctgtcctcctgctctttgctccatgagaaagatccacctacgacctcaggtcctcagaccgaccagcccaaaaaacat

SEQ ID NO: 870 - DNA, 232 bp, Homo sapiens
gttatcttgactgacaaatattctatattgaactgaagtaaatcatttcagcttatagttcttaaaagcataaccctttaccccatttaattctagagtctagaacgcaaggatctcttggaatgacaaatgataggtacctaaaatgtaacatgaaaatactagcttattttctgaaatgtactatcttaatgcttaaattatatttccctttaggctgtgatagtttttg

SEQ ID NO: 871 - DNA, 153 bp, Homo sapiens
ttgccttgatttggtggggtacagtggatgtgaatactgtaaatagcttgtgctcagactcctctgcgtggagagggtgggtgcaggaggcagaccctccccccaaagccccctggggagatcttcctctctctatttaactgtaactgaggg

SEQ ID NO: 872 - DNA, 273 bp, Homo sapiens
gaggattcgctgttgaaacaagttgtccaagcaatgttatattcatttttatacttattgggaaagtgtgagttaatattggacacattttatcctgatccacagtggagttttagtaattatattttgttgatttcttcattttgttttctggtataaaagtagagataatgtgtagtcacttctgatttagtgaaaccaattgtaataattgtggaaatgttttgtctttaagtgtaaatattttaaaatttgacataccctaatgttaat

SEQ ID NO: 873 - DNA, 183 bp, Homo sapiens
acagagcaagaacccgtgtcttaaaagaaaagaaaaacaggaggctgggtgcagtggctcacatctgtagttccagcactttgggaggtgcaggcagaggcggaagcggaaggatcacttgaggccaggagtttgagaccatcatgggtaacatagtgagacacccatctcttacaaaaaatt

SEQ ID NO: 874 - DNA, 280 bp, Homo sapiens
gaaaatagcaatgtgctgctctaagcattagaggttcccaagtctgcgcttcagaatgggattatctgggaaacctggtagagaagacagtttgtttttctttttaaaaagtgttgagctgtggtttagggtattaaataataaaaactcatctctattttccatatccacatatttataatattttactctttatgggcaaaaatttattctttcaaaccaccccctactatgcctcaacatgtctattacattaaaattatctcatatgtagagcaag

SEQ ID NO: 875 - DNA, 241 bp, Homo sapiens
cttgcagtgctggaaatagatctcatttttaggttttctcttcgttccagataccaaataaatgggacagagaataaaatttttgttaaaatatgtgctcatctcctaagtagctcttcagagtctgaccgtaagtaaaaacacacagaattgtgttgactgggggaggtgaatcacaaaaaagttacgaggagtttaagagttaaatattatttgatcgtggctgtcaaatttagtgaac

SEQ ID NO: 876 - DNA, 249 bp, Homo sapiens
catgaagtgtggaatgtgtcactacgattgttgataaagctgaggccacttgcaacttgattttttaaatgaaatagataaagtctttttgaataatatagtatgcactgctatttgcttgattatgtaatgtcaaaagtttaactatattccaagtacaaaaacatactggattacattgaggatgttgaatagcattcatgatggctttgttttggtttggggcagctgtcaccagctaaagcaatg

SEQ ID NO: 877 - DNA, 282 bp, Homo sapiens
tctgtgttggaaacctgcgtcatgtaaatatctgcaaatcatgacagtctaaagtgcaaaccattttcagagactttggggaatgcagtgatcagaagtggctaatttattttatttctgattattttatccagagggtacttttttaatggatatttgtaaatcttccacttaaccactgaaaattattttgttttaatcccacccttccatccatacctctgcctccccaaaaagctcctattaatttgcttatccccctcatgtagctagttgaatgtg

SEQ ID NO: 878 - DNA, 205 bp, Homo sapiens
gctcgtaacacaactctcatctcaggctcttctaaagagcttttgtattctaaagaggatttttccatcagagaggtaggagctgtaggaaccccgagggcagataagcagccctcactctagataaggtatgctgggggagcttactgagggaatcctgtacacagcccacatcaaaggaaggctgagaatggcctgtggctcc

SEQ ID NO: 879 - DNA, 295 bp, Homo sapiens
agcaggtgcctgaactcgtaactagagaagagttatccttcttccctgccttggaagccctggcctgggaggaggtcataccccaccgttggagcccagctgcctgttttcttttgcaggggatctgggcacctgtgccttgaggagatgctgccaggagcatgggactctgacagtcctttgtataaaggactaaagggagctgcccttttgaccctgttctaagctctgccttgccaagcccatagtgtgtgcccaaaagctgtcaagtggccaagacagctcgtttctggag

SEQ ID NO: 880 - DNA, 192 bp, Homo sapiens
caagtccaccagtctctgaaattagaacagtaggcacggtatgagataatcaggcctaatcatgttgtgattctcttttcttagtggagtggaatgttctatccccacaagaaggattatatcttatagacttgtcttgttcagattctgtatttacccattttattgaaacatatactaagttccatgtat

SEQ ID NO: 881 - DNA, 212 bp, Homo sapiens
tttgtacattcctgatactgggtacaagagccatgtaccagtgtactgctttcaacttaaatcactgaggcatttttactactattctgttaaaatcaggattttagtgcttgccaccaccagatgagaagttaagcagcctttctgtggagagtgagaataattgtgtacaaagtagagaagtatccaattatgtgacaacctttgtgtaa

SEQ ID NO: 882 - DNA, 257 bp, Homo sapiens
aagctgtttgtcgtaacttgaaattttatcttttactatgggagtcactatttattattgcttatgtgccctgttcaaaacagaggcacttaatttgatcttttatttttctttgtttttatttttttttttatttagatgaccaaaggtcattacaacctggctttttattgtatttgtttctggtctttgttaagttctattggaaaaaccactgtctgtgtttttttggcagttgtctgcattaacctgttcat

SEQ ID NO: 883 - DNA, 223 bp, Homo sapiens
ctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaag

SEQ ID NO: 884 - DNA, 275 bp, Homo sapiens
ttattattgcttggtatttgtgctctgtttaagaaacaggcacttttttttattatggataaaatgttgagatgacaggaggtcatttcaatatggcttagtaaaatatttattgttcctttattctctgtacaagattttgggcctctttttttccttaatgtcacaatgttgagttcagcatgtgtctgccatttcatttgtacgcttgttcaaaaccaagtttgttctggtttcaagttataaaaataaattggacatttaacttgatctcc

SEQ ID NO: 885 - DNA, 232 bp, Homo sapiens
acgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagct

SEQ ID NO: 886 - DNA, 256 bp, Homo sapiens
aagcagtaaaccaactaatatttattgaagacctactttgtcctctacatagggtagcttctgtcagggaatcttggttcttcccaagaaacactgattttctttcagggagacttcatgtgttcatttatttccaccacagcagattttaagaaattataatatgtaatatttgatatctataaagagtatatctaacgtgaataaattatgaagcatactaatgagtacctatgacccataacacatatacatt

SEQ ID NO: 887 - DNA, 256 bp, Homo sapiens
gagtcggcgcactccatgcgcaagcagaacgtggtacccaccgtgctggccttgggcagcgacgtggacatggacgtgctcaccacgctcagcctgggtgaccgcgccgccgtgttccacgagaaggactatgacagcctggcgcaacccggcttcttcgaccgcttcatccgctggatctgctagcgccgccgcccgggccccgcagtcgagggtcgtgagcccaccccgtccatggtgctaagcgggcccgggt

SEQ ID NO: 888 - DNA, 224 bp, Homo sapiens
aaatctataattaattgggccaacttttaaaatgaagatgctttttaaaactaatgaactaagatgtataaatcttagtttttttgtattttaaagataggcatatggcatattgattaacgagtcaaatttcctaactttgctgtgcaaaggttgagagctattgctgattagttaccacagttctgatgatcgtcccatcacagtgttgttaatgtttgctg

SEQ ID NO: 889 - DNA, 216 bp, Homo sapiens
taataatagtatcagtcggtgcaacagttggcaacatgtgccttcacactttaccataaagagacgggtttgagggtttgccttctaaagtctgcaacttcaagaaaaaaaaatcgacactgtggattgactttcccggtcactatataaagcaaataaacttaaaacactttgtaaccatgtatttactctgccaggtgcctatattccaataaa

SEQ ID NO: 890 - DNA, 207 bp, Homo sapiens
aattttctttgtggcagtcatttattaaggattcaactcgtgatacaccaaaagaagagttgacttcagagatgtgttccatgctctctagcacaggaatgaataaatttataacacctgctttagcctttgttttcaaaagcacaaaggaaaagtgaaagggaaagagaaacaagtgaccgagaagtcttgttaaggaatcaggtt

SEQ ID NO: 891 - DNA, 43 bp, Homo sapiens
aaaataggcaaccagaagccttctgtcagtggagtagccattc

SEQ ID NO: 892 - DNA, 239 bp, Homo sapiens
agaagccagctgaagcccaccaaaaccaagatggccatgagagtgacctctggttgtcctcactgctacactcccaccagcaccatgacagtttacagatgccatggcaatgtcaggaagttaccctatatggtctaaaaggggaggcatgaataatccaccccttgtttagcatataatcaagaaataaccataaaaataggcaaccagaagccttctgtcagtggagtagccattct

SEQ ID NO: 893 - DNA, 117 bp, Homo sapiens
cccccttcagtcggctctcattctccttcctgctgccctgtgaagaagaacatatttgcttccccttctgccatgaatgtaagtttcttgaggcgtccccagccatgccaaactgtg

SEQ ID NO: 894 - DNA, 285 bp, Homo sapiens
attagttccccacggagaagggatggatagtctgtgcttcgggggtctaaggaaggcttcctgcaggtgctggtacctccttaggtctggggtggttccttctaagtttccttaccctgcctgcatcacctctgcctcttatgacctctgtgcaaagactgggaagggtcacccccaatggctgtgaacgaacctgtttgtgattctaaacagggcacgggaccatcctacaataaaaattacccagcctaaaatgccagtagtgccagtagtccctgtttagaa

SEQ ID NO: 895 - DNA, 132 bp, Homo sapiens
aaatatcttcgagacttgggtgtttgttaataactaataactggagtaagctacaggatctaaagcagccctttttacagtctagttaggagagagaaaataattgcaaatatccacttagaggcaaagaac

SEQ ID NO: 896 - DNA, 272 bp, Homo sapiens
ctgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaa

SEQ ID NO: 897 - DNA, 158 bp, Homo sapiens
aattagctgggcgtgatgacaggcacctgtaatctcagctactcgggaggctgagacaggagaattgcctgaacccggggggtggaggttgcagtgagccaagatcatgccactgcactccagcctgggcaacagaacggaactctgtctcaaataaa

SEQ ID NO: 898 - DNA, 177 bp, Homo sapiens
cagttcagcaagctaacataataataaaaacaagttttgctgtcattaagttttatcattgagctgttaggagggaagaactacttaggtatttccatttggaatggcaggttcaccacagaggctcacattgagatcaagttgtcttcgacagcctttatagccactgtttgcctc

SEQ ID NO: 899 - DNA, 238 bp, Homo sapiens
gttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataa

SEQ ID NO: 900 - DNA, 249 bp, Homo sapiens
gtcagggacgttgcctgggcccaaatgtgtagtgtggtctgggcaggcagacctttaggttttgctgcttagtcctgaggaagtggccactcttgtggcaggtgtagtatctggggcgagtgttgggggtaaaagcccaccctacagaaagtggaacagcccggagcctgatgtgaaaggaccacgggtgttgtaagctgggacacggaagccaaactggaatcaaacgccgactgtaaattgtatctt

SEQ ID NO: 901 - DNA, 137 bp, Homo sapiens
acacgtacacacatccctcacttctcttaagccaagaagtttgctttccctagctgcagtgtagatggctcttgtttttgtttttttgttttaatcatttggcattcacatgtggctgttaatatgtgcttgttttt

SEQ ID NO: 902 - DNA, 255 bp, Homo sapiens
taatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagt

SEQ ID NO: 903 - DNA, 300 bp, Homo sapiens
aaatgcaagcttccagatcacacactgaacactaaccttctagtcttctcctaaacttcaaaggttgcaactattttgttgttctaaggagacatccccacatttcccagcatgctttgggaaaggagacggatagaagataacctgatggccagaactccctgcatgcactgcagtgaggaataaggacaggagtgcacttcccctgatgtgctggggaccggggataaaggctgggctctatttcccgggatgcctcaggactgtcagaaaaagagacagaactaccatttcaatggc

SEQ ID NO: 904 - DNA, 219 bp, Homo sapiens
ttgtgaaaactatgaatcagggtatgaaattcaaaacctccacctgcccatgctgcttgcatccctggagaatcttctgtggacatcgacctcttagtgatgctgccaggataatttctgcttgccatgggcatctggccaccaaggaatttcgcaccctgacgattactcttgacacttttatgtattccattgttttatatgattttcctaacaatc

SEQ ID NO: 905 - DNA, 268 bp, Homo sapiens
ctgggatttcttctgagactgtggtgaaactccttccaaggctgagggggtcagtaggtgctctggagggactcggcaccacttgatattcaacagccacttgagccaaatataaaattgtatttacagctgatggactcaatttgagccttcaaacttgtagttatcctattatattgtaaactaatacattgtctagcattgatttggttcctgtgcatatgtattttcactatgtgctcccctccccagatcttaattaaaccag

SEQ ID NO: 906 - DNA, 214 bp, Homo sapiens
gtctctcattaacagccagtagcttattggtgatcctagatgcagcctgcaaccttttgtacaactcacagaagcactgatttgctgtcaaatggtggaaaagttcaagctgccaaactttttcttaaaggaccaaacagtgaatactgtaggccttaactgttgcaacaccatagcctctgttgcaacaactcaactctgtccttgtagtaca

SEQ ID NO: 907 - DNA, 71 bp, Homo sapiens
tcacttgagcttgggtgaggtgaggctgcagtgagtcctgatcatgctgctgcactcaatcttggacaaca

SEQ ID NO: 908 - DNA, 238 bp, Homo sapiens
ccccaaagaggagtcgctacacttaccttgaaaaggccattaaaatccataactgatttccaagctggtgtgttcaaggcgaggacggtgtgtgggtggccccttaacagcctagaactttggtgcacgtgccctctagccgaagtcttcagcaagaggattcgctgctggtgttaattttattttattgaggctgttcagtttggcttctctgtatctattgactgccctttttgag

SEQ ID NO: 909 - DNA, 235 bp, Homo sapiens
cgtgaacagcgtttccaattagaatctgcctgaaaggaggtcccatttgcccactgagcatcctgtgttctcatggtggctctaactccagaagattttaacacagtctcatcaaacactgctttcagggaggaatttacactgaggttaaaaggactgttgaggactaatgctaacagaagctaacatttattgcgtaggacaatacactaaacacttcacatgtattatccca

SEQ ID NO: 910 - DNA, 235 bp, Homo sapiens
gattattcagactaatctgtggtcaatacagagcatctttatttaaatacatattcaagttagtgtcaaaaagagtgcacaaagtgctgctggcactggaattagatgtttccttactgacctctggtatctcctgataacaggcccctcctgcttagtgttgggaaagtcccagattgatctagacacaactaacagctgatatgaaagatttgtcctggaatcacatgtctcc

SEQ ID NO: 911 - DNA, 276 bp, Homo sapiens
gagaggaggtggttgccttaatcccccccgccaacccccttatgttagccaccagcccggaggtaaggggtgcctggaggagcaggaggtcaatagtccaacggcagaaaggtgtcagagtggaggcctccctccccggccccctcctaccccccagagcggcctcgtcctgtctggggtcagataagccacctaagcggggtggggggtagatactcccaccgcaccaaggcctccccttccacagttggctcctttatcactttcccttcagtt

SEQ ID NO: 912 - DNA, 257 bp, Homo sapiens
acagaccaggacattccatgtgcctcatggcactgccacctggccccttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttccc

SEQ ID NO: 913 - DNA, 260 bp, Homo sapiens
catgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttga

SEQ ID NO: 914 - DNA, 170 bp, Homo sapiens
aattttctacgcctctggggatatctgctcagccaatggaaaatctgggttcaaccagcccctgccatttcttaagactttctgctccactcacaggatcctgagctgcacttacctgtgagagtcttcaaacttttaaaccttgccagtcaggacttttgctattgcaa

SEQ ID NO: 915 - DNA, 233 bp, Homo sapiens
gggtgctctcttccactacagagaatcctgaagaaaagggaaggtgtttcccatgatggtgaatgtcactgccatgaattcctgaatctacctgctgctgggagtcagagtccaagcataacccgtgtagcataaaagcagcgctgtagccctattccagtctttttcgttaatgtccagagtgaacaacaagagttagtcaatcattaactgttgactgttgattctcataa

SEQ ID NO: 916 - DNA, 243 bp, Homo sapiens
ttcagagctctcagtgtgcagttcaggaattaagatacttggaatagctgtggaggaagaacctaaattgcaaagatctgctattgccagctctcaacccaagtcagtgaattgtcaacctgcatatcctaaaaatgtcaaaatgctgcatctggttaaatgtcggggtaggggggaagctgaaggtgctcgcttcatttgccttgtttactcatcctgccctgtaatgtctgtaatcctgaa

SEQ ID NO: 917 - DNA, 229 bp, Homo sapiens
atggcaccagctttttcagctctcttattttttccttaagtagcatttattcctaaggtaggcagggtatttcctagtaagcatactttcttaagacggaggccatttggttcctgggagaataggcagccccacactttgaagaatacagaccccagtatctagtcgtggatataattaaaacgctgaagaccataaccttttgggtcaactgttggtcaaactatag

SEQ ID NO: 918 - DNA, 286 bp, Homo sapiens
aagagcatgtcgaagagatcagtgaacttttctatgatgccaagtcctccgccaaaatcctggctgaccagcaggataagtacatgaagtgagatggctgaggttttcagcagcaagagactccccaggtgtgcctggcctgggtccagcctgtgggcgcttgcccctgggcttggggctgccgtccccactcaggcgtgggctgcagcgctgtcagttcagtgtggaaagcatttctttttaagttatcgtaactgttcctgtggttgctttgaaagaacccttc

SEQ ID NO: 919 - DNA, 269 bp, Homo sapiens
cttactcactgtgatcaaatggtgaatatgtaccaagacattctgacagaacttagcaaggaaacagggtcctctttcaaatcaagcagcagcaaaggagagaaaacattagaatttgttccaataaatctacatctgcaaagaatgcaggtacacagccctcacttgaaagatgctctctacgatgtcatcactgtgggagccccagctgcccattttcagggatttaagaatggtggtcttcggaagctactccatagatttgaaac

SEQ ID NO: 920 - DNA, 233 bp, Homo sapiens
agactgctgcagacgggaaaaccactcgccataactactacttcatcaattatcgtactcttgttaatgtggtaaaatataaactggaccacatgagcagaagaattgagaccgatgagagagattcgaccaaccgggcttccttcaaatgtcctgtctgtagtagtactttcacagacttagaagctaatcagctctttgatcctatgacaggtgaggtttatccagtttgt

SEQ ID NO: 921 - DNA, 242 bp, Homo sapiens
agtgtctggtgctgtgcaggacaaagggtcaatccacaaatttgtcccttacctgattgctggcatccaacactcatgccaggacattggtgccaagagcttgacccaagtccgagccatgatgtactctggggagcttaagtttgagaagagaacgtcctcagcccaggtggaaggtggcgtccatagcctccattcgtatgagaagcggcttttctgaaaagggatccagcacacctcct

SEQ ID NO: 922 - DNA, 175 bp, Homo sapiens
tggactacgaggccggcgtcctcgccttctacgacgtgacgggcggcatgagccacctgcataccttccgcgccacgttccaggagccgctctacccggccctgcggctctgggagggggccatcagcatcccccggctgccctaggggccaggaccggcgtgacagcctccaga

SEQ ID NO: 923 - DNA, 268 bp, Homo sapiens
gcagaggccagctgccgcaagacagcaatgacagtccacctgccgacctgattcctgcatcatggaataaccacatggctaccttctatcctctgttcccaaatggtggtggcacttatcctgaagtcgtcaatgatttccctttgaaactactttattttactaatttaaactattttgtactgatgtagccctgaggtagttcatgaaaatgctgtgcactcattccatggaataaatgttggaaagctgatcttttctgatataa

SEQ ID NO: 924 - DNA, 230 bp, Homo sapiens
tgtaatggaacttagccatttttcaaagcaattgaaatgcattgctctggatctgttccttggcagtggactcagaaagccaacatgtggctcctcccagcccataaccagtatttttgctgcttctgaatacaaattggttggttttgacttcagattgaacttactgtagcctcagatgatttcccccctccgcctccaggaagaaagaatgttactgccttaataaa

SEQ ID NO: 925 - DNA, 247 bp, Homo sapiens
gtaatatgtgccaatgctatttgtgaaatgtttggtctttctaaacgactaaaggatttgttgggtttttgcttaagttttgaaccaaatcctagagccagctgataatatttaataatctagaggagagaataatgatgtaccaataagtggagattcctccttatgatgtatgctaggttatggaagatgtaaaatattcaactttttcctcctttttttggactttgtattttactgcatgttt

SEQ ID NO: 926 - DNA, 250 bp, Homo sapiens
  misc_feature (217)..(217): n is a, c, g, or t
ggaggcccagttcaccctgatttaggagaagccaggaatttcccaggaccctgaaggggccatgatggcaacagatctggaacctcagcctggccagacacaggccctccctgttccccagagaaaggggagcccactgtcctgggcctgcagaatttgggttctgcctgccagctgcactgatgctgcccctcatctctctgcccaacccttcccncaccttggcaccagacacccaggacttatttaa

SEQ ID NO: 927 - DNA, 255 bp, Homo sapiens
gagatgcaggtaaaactgctccagtccctgggcctgaaatcaaccctcatcaccgatggctccactcccatcaacctcttcaacacagcctttgggctgctggggatggggcccgagggtcagcccctgggcagaagggtggccagtgggcccagccctggggaggggatatccccccagtctgctcaggcccctcaagctcctggagacaaccacgtggtgcctgtactgcgctaactcctgattaatacaatg

SEQ ID NO: 928 - DNA, 289 bp, Homo sapiens
actcagaatcaaagcaaaaaggctgaaggagccccaaaccagggcagaaaggcagagggaaccccaaaccagggcaaaaagacagagggaaccccaaaccaagggaaaaaggcagagggaaccccaaaccaaggcaaaaaggcagaaggaaccccaaaccaaggcaaaaaggcggagggggcccagaaccagggtaaaaaggtagatacaaccccaaaccaggggaaaaaggtggagggggccccaacccagggcagaaaggccgagggggctcagaaccaggccaaaa

SEQ ID NO: 929 - DNA, 232 bp, Homo sapiens
aaatggaaatcccttgacatctgctacctcctcccccctcctctgaaacagctgccttagcttcaggaacctcgagtactgtgggcaatttagaaaaagaacatgcagtttgaaattctgaatttgcaaagtactgtaagaataatttatagtaatgagtttaaaaatcaactttttattgccttctcaccagctgcaaagtgttttgtaccagtgaatttttgcaataatg

SEQ ID NO: 930 - DNA, 180 bp, Homo sapiens
tcagccccaggagctattggtgggttttagcagttttgtctttaccgtttttagttctccttgattctttgttttcttcctttatcgtttttaggtttggtatgtgttgttttatttccatggttcctcaagtttcctttttaaacatttgcatttgctggacaattgcaatttttttta

SEQ ID NO: 931 - DNA, 66 bp, Homo sapiens
gccatgctctcaccctgcatatcctaggtttgaagagaaacgctcagatccgcttatttctgccag

SEQ ID NO: 932 - DNA, 284 bp, Homo sapiens
agacagacagttccactgtggagcatgtgcgctgcttccagccacccatccaccagtccttggccaccacttgctaagcagaagatcctgcagacccttatctggaggaggaagagaagcaggagagagaaagccacagccagcctgccataggatccaactggacaacgtgtgggatggacctggaaacaagcacctccccaaacacatcaccactccctagggcggggcctgtgcatgctctcccatgacatctccatgctggtttctccatagcataaatg

SEQ ID NO: 933 - DNA, 276 bp, Homo sapiens
agaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgcta

SEQ ID NO: 934 - DNA, 241 bp, Homo sapiens
ggaaagattaactatttgcaccgaaatgtcttgttttgttgcgacataggaaaataaccaagcacaaagttatattccatcctttttactgatttttttttcttctatctgttccatctgctgtattcatttctccaatctcatgtccattttggtgtgggagtcggggtagggggtactcttgtcaaaaggcacattggtgcatgtgtgtttgctagctcacttgtccatgaaaatattt

SEQ ID NO: 935 - DNA, 213 bp, Homo sapiens
ttcaggaaaataacttagactctagtatttatgggtggatttatccttttgccttctggtatacttccttacttttaaggataaatcataaagtcagttgctcaaaaagaaatcaatagttgaattagtgagtatagtggggttccatgagttatcatgaattttaaagtatgcattattaaattgtaaaactccaaggtgatgttgtacctc

SEQ ID NO: 936 - DNA, 221 bp, Homo sapiens
ggaacagttagttctcatctagaatgaaagttccatatatgcattggtgaatatatatgtatacacatacttacatacttatatgggtatctgtatagataatttgtattagagtattatatagcttcttagtagggtctcaagtaagtttcattttttttatctgggctatatacagtcctcaaataaataatgtcttgattttatttcagcaggaataa

SEQ ID NO: 937 - DNA, 252 bp, Homo sapiens
ggtcctaagaggaaggtgacttctctctgtttgtcttaagttgcactgggggatttctgacttgaggcccatctctccagccagccactgccttctttgtaatattaagtgccttgagctggaatggggaagggggacaagggtcagtctgtcgggtgggggcagaaatcaaatcagcccaaggatatagttaggattaattacttaatagagaaatcctaactatatcacacaaagggatacaactataaa

SEQ ID NO: 938 - skipped

SEQ ID NO: 939 - DNA, 259 bp, Homo sapiens
aatcatgtagcagaatggcacccagaccactgcccaccagtgacggacatgcacgtggcagatcatgatttccagcccacggagccagcatttgaaccttgtataattaactttcagttatgatttcccatcgacattttctttgccctgtttgtagctgattgttgtgttttataaatcttctgttaaggcagaagggtgattatgagtggttcacagcagcccttataagctgggccagaaaatttcactaggtcag

SEQ ID NO: 940 - DNA, 282 bp, Homo sapiens
ggaggtcctcgcctgtgctggaggatgcttaaatggcagaggccaagcccagactccagacggacatgcggataaggccctgctgcggcagatggaaggcatttacgctgacatccctgtgcggcgtccggagtccagtgcacacgtgcaggagctgtaccaggagtggctggaggggatcaactcccccaaggcccgagaggtgctgcataccacgtaccagagccaggagcgtggcacacacagcctggacatcaagtggtgaagtcaggccagggcctt

SEQ ID NO: 941 - DNA, 36 bp, Homo sapiens
gtacaatttgaaactgatgcttcacctttcctttaa

SEQ ID NO: 942 - DNA, 292 bp, Homo sapiens
tttctcccagaattgtgggcttcactggaagtgaaggtgcaggaatgactggactgtccaccccagccctgcctgcctgtggttttggccagggagcaagccatgaggtgccctggcacatgcacaaattgatcctttgcgtgacagtcttgtatggaaaacagatgctgacagaattgtagactaccatgccacacaaaaaggctaaatatctactccaatgggtttccagttcagtttgaagtcaatcaaatttttgtatttttcggtgtctccttgattggttttgcta

SEQ ID NO: 943 - DNA, 191 bp, Homo sapiens
taaggtgccatggaacaggctgttcccaaatgctgactccaaagctctggacttattggacaaaatgttgacattcaacccacacaagaggattgaagtagaacaggctctggcccacccatatctggagcagtattacgacccgagtgacgagcccatcgccgaagcaccattcaagttcgacatggaat

SEQ ID NO: 944 - DNA, 233 bp, Homo sapiens
ctcgagttagtttttttatccataggtgagatatatagtaagtttttaaggcaaagtatttcttaggcttaagtttccttattttaaaaatagggtaatatgccctatctatctcctaattcctccatgaattgaggattaaatgtgatgtttgcaattgtggtatatgtgtttagcagtacagatgctcaataaggcatagcaccctatgttgactcaggttatttccagaa

SEQ ID NO: 945 - DNA, 218 bp, Homo sapiens
gggttcttagtctcagcactatgacattttgggctgactacttatttgttaggcaggagctctcctgtgcattgtaggataattagcagtatccctggtggctacccaatagacgccagtagcaccccgaattgacaacccaaactctccagacatcaccaactgtcccctgcgaggagaaatcactcctgggggagaaccactgacccaaatgaatt

SEQ ID NO: 946 - DNA, 59 bp, Homo sapiens
caagtgatctgtacatctcagctactcaggaggttgagtcaggggaacctcttgaaccc

SEQ ID NO: 947 - DNA, 246 bp, Homo sapiens
cattcggcgtagtacccagagagctcaagatgtgtggcagttttcggatggaagctcgagagcccttaagttctgagaaaatttgaagcccccaggggtggggtggacggtgccgcccagtcgacgtcagcgtggtctgtcatcctgctagtttgtgatgttttctgacagtagcctccaagaagccgttgtgcgaagacagagtcctgcagagtccttccagcctaggcctgcagcgccatttta

SEQ ID NO: 948 - DNA, 250 bp, Homo sapiens
agcctgactgctctcagtgcaaagacccagaacccagccttccttcacctgaaacagctgcagcgtgcacacacacttcttgtgcatatatctctggtctatttattttcaaaactaagtataatccaaattgaatgctggaatcagatttttccattctgaatgtgtttaaataacatggccaaggataatttctttctgttttcttgacatttataggtagtataagatatgtgacttccaaataaac

SEQ ID NO: 949 - DNA, 279 bp, Homo sapiens
gggtaaccatgaacttgatggaagaaaatgttacatctttattttcagcaatgaaactgaaatttagccttactcccaagttataaatgctggcaacaaatcacagtagtaaaagcagtacctgggattttcccaccaatacaaaccagttacagcaactgtaatgtaacataaaaagggcatcttgaagtattgttcatatttgtcacctcttggaatgatagcagatcctgtaagttgatgtattaattaaaaagcccatatattactgcatctcaa

SEQ ID NO: 950 - DNA, 248 bp, Homo sapiens
gatggccaggaatggactcataccattggcacattaggctaatcctggttttatgtgaagtcagcaattaagtgttcccactagaactgacctaagccactgattaatatttaatgagggaaggtaggggagaatctagccattttataatgccagaaatctatatatgttatctgatgccatttttctgaagtagcctcacatgtggtccccctgcagttcagcagttaacagatgacttttttagt

SEQ ID NO: 951 - DNA, 228 bp, Homo sapiens
gtagagtaagtaaaacttctctgaaaaataagttcatacagatatgaaagctgaacttatttatagaagggagtctggatatcagactaacagcctatggaagaagtagaaaagttgttcaagaactacccttgcaaaagatgcaacatgcagataactacaattaggttctaagaggtcttgtgaaaataaaatgattcctattttgttcagactttgatggaacag

SEQ ID NO: 952 - DNA, 215 bp, Homo sapiens
tggcttttgttggttgttggattgactgtgatttaaaatgttaaagatgatataatgcatcttgttctgcttctaggctgaaaggtcactgaggcagagctgtttgtaccttgtatcccctggaattttgcctaaacatttgtgtactcatagggtggtaggagatagtccgcagatggtctaaagaatgccatgtgatactgtgagatgccaat

SEQ ID NO: 953 - DNA, 263 bp, Homo sapiens
  misc_feature (198)..(198): n is a, c, g, or t
ttttaaacttggctgtattgtgtacaactattataccatcttttataaacacagttttttaagaaatttctttttgtaagttacaacattccactggatccttatattgcctgtagtggaagagggtcttgtgtgtctgccccttctagttttcactcatgcagaagcaacataaccttctgatttgcacaataaatnacatatatttagcaggatttttatttgccgtgatatataggataatttagtctttggcatgtggc

SEQ ID NO: 954 - DNA, 181 bp, Homo sapiens
atcgggactggctggcgcccttgttatgtgctattttaatcagtgtaacattggtcaagttgttacccatgtatgctgtgtttatcatgtgtatatcgtccagaaagtattaaggctttaggtagatgcaactggcgaaccttggagagggaatgctgattgtcttgaccaaacccacagc

SEQ ID NO: 955 - DNA, 213 bp, Homo sapiens
gtgccatgtggctacattagttgatgtttatcgagttcattggtcaatatttgacccattcttatttcaatttctccttttaaatatgtagatgagagaagaacctcatgattctaccaaaatttttatcaacagctgtttaaagtctttgtagcgtttaaaaaatatatatatatacataactgttatgtagttcggatagcttagttttaa

SEQ ID NO: 956 - DNA, 275 bp, Homo sapiens
gatgagtacatatgcatgtttcggggacttggcccttctgatgaggggccctcggtactctggataacgaagcttgtgcagagtggtaaccatgcttacacactaaactataatataaaggaaatgaagccatgttaatctgagagcagtgtcgccatagttgtgttgtttacaatactctataaatgggttcctgttgccctgtaattaaactgctgcccgtagaggcctttcagttccttttctgtccttccccttcttaacacaagctcaaa

SEQ ID NO: 957 - DNA, 167 bp, Homo sapiens
atgctaagtgtatttgtgttccccaagtgtacaagccttctatcaaaagtatgttctataactcatatattcaaggtgtagggtatgaaaatgcaaagtttaggagagcactttaccaagctggtgtcctccaaactgaaattgtttgtaacgatagtcttttacag

SEQ ID NO: 958 - DNA, 273 bp, Homo sapiens
tattctcatgtacctaagttgtggagaaaataattgcatcctataaactgcctgcagacgttagcaggctcttcaaaataactccatggtgcacaggagcacctgcatccaagagcatgcttacattttactgttctgcatattacaaaaaataacttgcaacttcataacttctttgacaaagtaaattacttttttgattgcagtttatatgaaaatgtactgatttttttttaataaactgcatcgagatccaaccgactgaattgttaa

SEQ ID NO: 959 - DNA, 124 bp, Homo sapiens
aaaaatagatgttgggtctcgtcaagtgcttaccctgcatccattgagatgataatatggttttacttttttagtctgttaatatggtacattacattgatggcacgatatgttaaaccaacct

SEQ ID NO: 960 - DNA, 200 bp, Homo sapiens
agttcttttctttctagtttgctgagaatttttatcaaaaatagatgttgggtctcgtcaagtgcttaccctgcatccattgagatgataatatggttttacttttttagtctgttaatatggtacattacattgatggcacgatatgttaaaccaacctttcattcctgaaaaaaactctagtcatttggtattattct

SEQ ID NO: 961 - DNA, 255 bp, Homo sapiens
aacacagactacaggttccgcgtatgtgcgtgtcgtcgctgtttagacacctctcaggagctaagcggagccttcagcccctctgcggcttttgtattacaacgaagtgaggtcatgcttacaggggacatggggagcttagatgatcccaaaatgaagagcatgatgcctactgatgaacagtttgcagccatcattgtgcttggctttgcaactttgtccattttatttgcctttatattacagtacttctta

SEQ ID NO: 962 - DNA, 44 bp, Homo sapiens
aatattgttgctgatttcagagggatattcactaataaatgtat

SEQ ID NO: 963 - DNA, 147 bp, Homo sapiens
tttccattccatgggattcacattggtttgtagcatttaacataactagtatgttgtattatatatatgtgtatactgattgaaatttttaacagatttgtactttttttaaaatgaaagttgctagttctgcttgaccaagtagtg

SEQ ID NO: 964 - DNA, 177 bp, Homo sapiens
agagcccttcgagcaaagcgtgccgaagttagttgtcttctctgtggtggtcctttcttatgtcctcataaaagctcagatgatggtatctgtgagtatgttttgcaaattcaaaatatagtttggtaatttttttttccagttgatttttaaaaagaactgctgtacagagcttgt

SEQ ID NO: 965 - DNA, 102 bp, Homo sapiens
ttggaataattatagtcactatgacaaaattactttgcctaatgatagcatatagttaatgttactgtgcaaataactgtgcaaatgaatgacttgagaagt

SEQ ID NO: 966 - DNA, 117 bp, Homo sapiens
ctacagccaggcataacatatccactgtgtgcatagagggtctcttcacgttgatgcttggcattccatcagctttctctaagtctttgctcaagttcaaccttaaaatgatgttag

SEQ ID NO: 967 - DNA, 146 bp, Homo sapiens
ttcagtgactgaaaaggaggttcccagcaaagaagagccatctccagtgaaagccgaggtggctgagaagcaagccacagatgtcaaacccaaagctgccaaggagaagacggtgaaaaaggaaacaaaggtaaagcctgaagaca

SEQ ID NO: 968 - DNA, 266 bp, Homo sapiens
gtgtcaataccaaaatgtctgagtaacttcttaaatccctgttctagcaaactaatattggttcatgtgcttgtgtatatgtaaatcttaaattatgtgaactattaaatagaccctactgtactgtgctttggacatttgaattaatgtaaatatatgtaatctgtgacttgatattttgttttatttggctatttaaaaacataaatctaaaatgtcttatgttatcagattatgctattttgtataaagcaccactgatagca

SEQ ID NO: 969 - DNA, 225 bp, Homo sapiens
ccaagtctcttgacacctcagagtgactgtaagctaccagtaagacaagtgggaagaggcacgttcatcaaacctgttactaaaccagcctagtcatagctcatccccatctctaaatgtgtccacacaaccacatctgccttttccacaagcttttcacaaagaaggtgagagagaaggaaaccttgggaggaggacattactggttgttctggctggtttgaa

SEQ ID NO: 970 - DNA, 256 bp, Homo sapiens
acagtagaataaccacgggcaattaaactttaaattttctgagcagcattttggtatttaaacatttcttgtaaaaagctgagacagtttgtaagaaaagaatccttaaaatctagatttataccattttttaaagtcccacctttcaatgtttaataaaacaaaaagaaatccttaatctaaaagctaaattatttttgaatggaaatactactgagaccattgacactggataacagtaatgatcccattacca

SEQ ID NO: 971 - DNA, 227 bp, Homo sapiens
gggaagatactgctttagcctatcactccttattttattttgtttggttttatgccctcagtgtcttagggaactttttaagagatcctctgctaccaaacaatgatgtggattcttttgcacagaaatatttaaggtgggatggtaaaaaatgtcacaaaagactcctcaccaatactttatgttgatatcacttaatattaaccagactttgctgtattgcaata

SEQ ID NO: 972 - DNA, 237 bp, Homo sapiens
gatatttcccaccttgtcagaaagaagaggaaaccagaggaagagagtccccggaaagatgatgcaaagaaagccaaacaagagccggaggtgaacggaggcagtggggatgctgtccccagtggaaatgaagtttcggaaaacatggaggaggaggctgagaatcaggctgaaagccgggcagcagtggaggggacagtggaggctggagctacagttgaaagcactgcatgttaa

SEQ ID NO: 973 - DNA, 221 bp, Homo sapiens
acaccggccttgcattgcctgcctggccccctgtcctctctggctggggagcagggaggtccgggagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttcc

SEQ ID NO: 974 - DNA, 157 bp, Homo sapiens
gagggtgcggctgtgcagcctgtcctgggctggtggctcccggagggccctgagctgagggcattgcttacacggatgccttcccctgggccctgacattggagcctgggcatcctcaggtggtcaggcgtagatcaccagaataaacccagcttcc

SEQ ID NO: 975 - DNA, 145 bp, Homo sapiens
taggttttcgtcttagttgtagcacacttaccctaattttgccaattattaatttgctaaatagtaatacaaatgacaaactgcattaaatttactaattataaaagctgcaaagcagactggtggcaagtacacagcccttttt

SEQ ID NO: 976 - DNA, 128 bp, Homo sapiens
gtgtcgccatggtaagcttgggccatcggtccccactgttggttttcattccttatctgggctgttgtgtggttaattgattgatcattttgaaagctagcacttgactcacactcggaatcccagaa

SEQ ID NO: 977 - DNA, 257 bp, Homo sapiens
agctggtgggttttgcccaagaaaggtcacgcggcacatgcagggattggaactcccaggccagggctctaggtcgctcccaccttttcatgtttctttctgtggccatgggtatagtggaaagacataaagctaaagccaacttttaatcctgaatgcactgcttgccaggtaaatgcccttggttgtggtatcttgttgagacttagttttcacagagggataatgaaccgttgcagaggtttattgagatcatt

SEQ ID NO: 978 - DNA, 110 bp, Homo sapiens
gaatgtgatactcagggcttactctatacaccaatgagtcttctttgatcctaagaccaccactgaagttgtttaggttcttttggacaaacatgataaacttcttcaga

SEQ ID NO: 979 - DNA, 218 bp, Homo sapiens
attataattgttgatattttccctttttaaaaaataccattgaaatcagcatgacaaaaataacactgttggcacttataggtaacgtgattgattcagtatcttagagtttacagtttgtgttttaaaaaaactgaaggtttttttttaagtgcaacatttctgtatactgtaaaagttataataactgaactgtttggtcgagtctttgtgtgtta

SEQ ID NO: 980 - DNA, 146 bp, Homo sapiens
taggcacaaaatttaattctcagagcctataaaaacagtaaaggaaataggcatgaacacacaaggccagataacagcagtaacattttggcaactgaaaggcaaacacagtggtagctaagttagcagaccaagaaaacttaatc

SEQ ID NO: 981 - DNA, 163 bp, Homo sapiens
taggcacaaaatttaattctcagagcctataaaaacagtaaaggaaataggcatgaacacacaaggccagataacagcagtaacattttggcaactgaaaggcaaacacagtggtagctaagttagcagaccaagaaaacttaatcaaaattagctggcatgg

SEQ ID NO: 982 - DNA, 182 bp, Homo sapiens
tgcagtcttatggtttagaaaacttgtttagctccatagaggaaagaatgttaaactttgtattttaaaacatgattctctgaggttaaacttggttttcaaatgttatttttacttgtattttgcttttggtacggccagaaatcgagcttgttttttcatagttcctgatattttcagaa

SEQ ID NO: 983 - DNA, 205 bp, Homo sapiens
gccagaccaactctgttgaaattcttgcatagagcaaacctgtgctcatttttaagtggcatgggagaggccccaagcctagtaaagcctagtctgtgtcttcacagtgctggtagaatgtgttcgtgtgtataaatatatgatatagatttatatatgttgctaacgccatatattgaaggccaacataactggtggacagggt

SEQ ID NO: 984 - DNA, 191 bp, Homo sapiens
gtagggtatgacttgtgagtccacaaggccagcagtatatatgctgaatggactgcttagcagtaacacactggaaaaatccaaaaagaatggatttcaagttggcaaaaaatgcattagaagtcagcagtgtgatgtggtcaggagaacaaccagagtgactgtgggatgaggtcttggatagctttgtt

SEQ ID NO: 985 - DNA, 272 bp, Homo sapiens
cctcccagaaggcaatgtgggcgatggctcccagtgctgatggtggtgattgctgcagcactggcagtgttcctggccaataaagacaacctgatgatctgaataatttgtgacaactgccttgggtgaaaatcagaagcaagcaactcagcgaaaaactcagaaggtttgggtacattacagcttgggttttccaactgacttaggatttctgactttttattaatttcttaacctactgtaaataaacttcacctgaccagattgttcct

SEQ ID NO: 986 - DNA, 108 bp, Homo sapiens
ttgttactgctgattcttgtaaatctttttgcttctactttcatcttaaactaatacgtgccagatataactgtcttgtttcagtgagagacgccctatttctatgtc

SEQ ID NO: 987 - DNA, 197 bp, Homo sapiens
tctttgtaagagtgtagaagcattccttctttgataatgttaaatttgtaagtttcaggtgacatgtgaaaccttttttaagatttttctcaaagttttgaaaagctattagccaggatcatggtgtaataagacataacgtttttcctttaaaaaaatttaagtgcgtgtgtagagttaagaagctgttgtacatt

SEQ ID NO: 988 - DNA, 245 bp, Homo sapiens
tggtgccctgagcaactgataatgcaaatgtggacaaagtgtctgttttctactctagcctgttcatatggaccaaatttcaacaaggaactcaaggaaaatttgtacctgccgtatttatgctttcatgtaaaaaagggttggggggaggggtgtctttttgcttttggtgaactttttttcaaaatcatttttccactgtttctgtctggttttaaaacaaattacagttttgtatggatttt

SEQ ID NO: 989 - DNA, 182 bp, Homo sapiens
gaaaatgccaagacctttggaaagatgaaacctcgttatgaaatcaactccctgattagataccactgcaaagatggtttcattcaacgtcaccttccaactatccggtgcttaggaaatggaagatgggctatacctaaaattacctgcatgaacccatctgcataccaaaggacttattc

SEQ ID NO: 990 - DNA, 256 bp, Homo sapiens
gtgtctcacaaaaaagtgtcaagctaagagttgctttcccttcccactgaaacagttgaagcgctgaaaacaggctaggggcagccctgccagtccaggagaactttctgcaatgactagaacgttctatataccgtttacttaaacatcttacaaattcaataaaattagaatcagttcctcagtcctgccacacttcagttgcttagcagccacacatgtatgtggccagtggcaactgttggacaagtcaagt

SEQ ID NO: 991 - DNA, 45 bp, Homo sapiens
aagagccaagttcaaagaaccctagcacaaatttgctttgggatt

SEQ ID NO: 992 - DNA, 206 bp, Homo sapiens
  misc_feature (181)..(181): n is a, c, g, or t
gaagttctggcaagattgaagtctgatattgcagtaatgatatttattaaaaacccataactaccaggaataatgatacctcccaccccttgattcccataacataaaagtgctacttgagagtgggggagaatggcatggtaggctacttttcagggccttgacaagtacatcacccagnggtatcctacatacttctttcaaga

SEQ ID NO: 993 - DNA, 74 bp, Homo sapiens
tctgttaatcattaggtgtgactgaatttcttttgccgttattaaaaatctcaaatttctaaatctccaaaata

SEQ ID NO: 994 - DNA, 291 bp, Homo sapiens
ttgagccttgaactttgacctctgcagcaataaagcagcgtttctatgacacatgcaaggtcattttttttaagaaaaaggatgcacagagttgttacatttttaagtgctgcatttaaaagatacagttactcagaattctctagtttgattaaattcttgcaaagtatccctactgtaatttgtgatacaatgctgtgccctaaagtgtatttttttactaatagacaatttattatggcacatcagcacgatttctgtttagataatacaccactacattctgttaat

SEQ ID NO: 995 - DNA, 296 bp, Homo sapiens
aaattcttcttttgtatgtccagtctcctgcacagcacctgcagcattgtaactgcttaataaatgacatctcactgaacgaatgagtgctgtgtaagtgatggagatacctgaggctattgctcaagcccagtccttggacatttagtgactgttagccggtccctttcagatccagtggccatgccccctgcttcccatggttcactgtcattgtgtttcccagcctctccactcccccgccagaaaggagcctgagtgattctcttttcttcttgtttccctgattatgatga

SEQ ID NO: 996 - DNA, 226 bp, Homo sapiens
atgagctgctgacttactgtgattcagattctagtcccatggctttgttcctgaaaatgataggcccaacccatggccagatgacagtcacaagacttgtgaatacgttaaaagaaggaaaacgcctgccgtgcccacctaactgtccagatgaggtttatcagcttatgagaaaatgctgggaattccaaccatccaatcggacaagctttcagaaccttattga

SEQ ID NO: 997 - DNA, 205 bp, Homo sapiens
cttctccttggaggacagtgggaactggagggtgagaggaagggtgggtctgtaagaccttggtaggggactaattcactggcgaggtgcggccaccaccctacttcattttcagagtgacacccaagagggctgcttcccatgcctgcaaccttgcatccatctgggctaccccacccaagtatacaataaagtcttacctcag

SEQ ID NO: 998 - DNA, 237 bp, Homo sapiens
ctgaccttgaggagtcttgtgtgcattgctgtgaattagctcacttggtgatatgtcctatattggctaaattgaaacctggaattgtggggcaatctattaatagctgccttaaagtcagtaacttacccttagggaggctgggggaaaaggttagattttgtattcaggggttttttgtgtactttttgggtttttaaaaaattgtttttggaggggtttatgctcaatccatgt

SEQ ID NO: 999 - DNA, 196 bp, Homo sapiens
tctagcaatgacagtgggaataaggttggcatccagcttcccgaggtggagctgtcagtttccacaaagaaagagtagcaggcctttgtatgtgtgtacatatatatatatataacaaaacatcagccttgggtggtgtgttcctatataaactccaaagggaaacacaccgactgcctcagcaatcatgcaaaga

SEQ ID NO: 1000 - DNA, 215 bp, Homo sapiens
accaggtcatatgtggcgtctcctagggtacagagagatattcattcatttcctcactcattttcatgtgtgtccattcattcaccagatattgagtgccgctatgtcaggcactatgttaggttaaggattcctaatgtttttgtgatcagggattccttggagaatattgaaagctatagatctttccttctgcccctaccttcaaataagca

SEQ ID NO: 1001 - DNA, 285 bp, Homo sapiens
gggcagaacctctgaagacgccactcctccaagccttcaccctgtggagtcaccccaactctgtggggctgagcaacatttttacatttattccttccaagaagaccatgatctcaatagtcagttactgatgctcctgaaccctatgtgtccatttctgcacacacgtatacctcggcatggccgcgtcacttctctgattatgtgccctggccagggaccagcgcccttgcacatgggcatggttgaatctgaaaccctccttctgtggcaacttgtactgaa

SEQ ID NO: 1002 - DNA, 215 bp, Homo sapiens
aatgatggtgctaaaattcttcctataaaattccttaaaaataaagatggtttaatcactaccattgtgaaaacataactgttagacttcccgtttctgaaagaaagagcatcgttccaatgcttgttcactgttcctctgtcatactgtatctggaatgctttgtaatacttgcatgcttcttagaccagaacatgtaggtccccttgtgtctc

SEQ ID NO: 1003 - DNA, 228 bp, Homo sapiens
gggacaatttgctgccaaacacccatgcccagctgtatggctgggggctcctcgtatgcatggaacccccagaataaatatgctcagccaccctgtgggccgggcaatccagacagcaggcataaggcaccagttaccctgcatgttggcccagacctcaggtgctagggaaggcgggaaccttgggttgagtaatgctcgtctgtgtgttttagtttcatcacctgt

SEQ ID NO: 1004 - DNA, 244 bp, Homo sapiens
cctcgtgggtttattattacctcatagggactttgcctcctgacagcagtttatgggtgttcattgtggcacttgagttttcttgcatgcttgttagagaaaccaagtttgtcatcaacttcttatttaaccccctggctataacttcatggattatgttataattaagccatccagagtaaaatctgtttagattatcttggagtaagggggaaaaaatctgtaattttttctcctcaactag

SEQ ID NO: 1005 - DNA, 262 bp, Homo sapiens
gagggttgtgattttgtctgcttagtatctcatcaacaaagaaatattatttgctaattaaaaagttaatcttcatggccatagcttttattcattagctgtgatttttgttgattaaaacattatagattttcatgttcttgcagtcatcagaagtggtaggaaagcctcactgatatattttccagggcaatcaatgttcacgcaacttgaaattatatctgtggtcttcaaattgtcttttgtcatgtggctaaatgcc

SEQ ID NO: 1006 - DNA, 248 bp, Homo sapiens
cccttcctcaagtggtgctattttaaaactaaaaaaaactttgaattggctatttttttaatgcaatattttttttctgaattcattatgatccccatattgggtaatgctgaacatttatctgaaacagatgaggatattattattttgtatccaaacagaaattcagataaagggaaatttgactagtgtaatctgagatatgtcatagggatttctttctgacaaaagggtgctttgctgttctt

SEQ ID NO: 1007 - DNA, 228 bp, Homo sapiens
aagctggcggtagatttgtgatgtcacagtgcaaactgcagtgactgtaaattggcctggcgtgtataaacgttttcagggaatgcagaaggtattaatgaagagacaaaacctttattccatgtgctttgcttcattctgtacatagctctttggctcgtgaacctaattgtaaactttcaggtatttttgtacaaataagggactgatgttctgtttcttgtaatt

SEQ ID NO: 1008 - DNA, 269 bp, Homo sapiens
ggcagcacgctgtaaaattattactgtattgtgtactggctataagatgtagacacctttcagtaagccaatcatttgtaaccattctagcagtgtcatattaggttaataaggctgctgtgttttaaagggcatttttatttgggttttggtgaaattctttaatttgttgattatattcacataaaatcagcattcattgacacatagctctaatgacatatgtatgaaaaaccatacactggatgacctagtcgattatttaagca

SEQ ID NO: 1009 - DNA, 220 bp, Homo sapiens
ataaaactgtttgacttctcaagtaacatgacttccttatttctgaacagtactggttactttcaaaatgaatttttattgagattttccattaactatttttttcaaagactcaaattttgtaccaagtaaatccaggctttatgtacaaacatgttgtttgttttatttggggctgggggaggtatatgatgagcagacttctcggaattcataataa

SEQ ID NO: 1010 - DNA, 276 bp, Homo sapiens
aaaaatggcgttcttctcttgtggcctgttattctgattgctgctgtatacagttttgtcactctttagtttttagttaagcatactgatagactttcctctaaaagccattcactccagattttacctggggaatattctacatactgcttactttctctataaaactcatcaataaatcatgaaaggcactgagttttgtaaatcaggaccctaaatgtttaattgtaaataagtttcagataattattatagctttgcgttgaagtttgttgt

SEQ ID NO: 1011 - DNA, 243 bp, Homo sapiens
ttttcagtttgtatatacccgtacaacgtgtcctcacggtgccttttttcacggaagttttcaatgatgggcgagcgtgcaccatccctttttgaagtgtaggcagacacagggacttgaagttgttactaactaaactctctttgggaatgtttgtctcatcccattctgcgtcatgcttgtgttataactactccggagacagggtttggctgtgtctaaactgcattaccgcgttgtaaa

SEQ ID NO: 1012 - DNA, 210 bp, Homo sapiens
attgccttggtagtgatagtgcccttggtgattctaatagtccttgtgttatggtttaagaagcactgctcatatcaggacatcctgtgagactcttccccctgactcccccattgtgttaagaacccagcaacccaggagcctagtacaatatagtgatgccatcccgtcgactctccatttaaattgtttctctttctgcataataaa

SEQ ID NO: 1013 - DNA, 274 bp, Homo sapiens
tagaaggcaaagcaaaactcccaatggataaatcagtgcctggtgttctgaagtgggaaaaaatagactaacttcagtaggatttatgtattttgaaaaagagaacagaaaacaacaaaagaatttttgtttggactgttttcaataacaaagcacataactggattttgaacgcttaagtcatcattacttgggaaatttttaatgtttattatttacatcactttgtgaattaacacagtgtttcaattctgtaattacatatttgactctt

SEQ ID NO: 1014 - DNA, 200 bp, Homo sapiens
caccccttgtttttcaagatactattattatattttcacagacttttgaagcacaaatttattggcatttaatattggacatctgggcccttggaagtacaaatctaaggaaaaaccaacccactgtgtaagtgactcatcttcctgttgttccaattctgtgggtttttgattcaacggtgctataaccagggtcctgg

SEQ ID NO: 1015 - DNA, 47 bp, Homo sapiens
ctttgaaccactttgcaattgtagattcccaacaataaaattgaaga

SEQ ID NO: 1016 - DNA, 225 bp, Homo sapiens
gcagcaaaataatagcctcggttctatgcatatatggattgctataaaaaatgtcaataagattgtacaaggaaaattagagaaagtcacatttagggtttattttttacacttggccagtaaaatagggtaaatcctattagaaattttttaaagaactttttttaagtttcctaaatctgtgtgtgtattgtgaagtggtataagaaatgactttgaaccact

SEQ ID NO: 1017 - DNA, 226 bp, Homo sapiens
ttctgtgcagagatgactgtccaagtgccacatgcctacgattgaaatgaaaactctattgttacctctgagttgtgttccacggaaaatgctatccagcagatcatttaggaaaaataattctatttttagcttttcatttctcagctgtccttttttcttgtttgatttttgacagcaatggagaatgggttatataaagactgcctgctaatatgaacagaaa

SEQ ID NO: 1018 - DNA, 269 bp, Homo sapiens
acagggttccagacgcatacaaccccagtgttgttggcccacggggaacgggcagaattggccactgaggagtttcttcctgttacccccattctggaaggttttgttatccttcggaagaaccccaattatgatctctaagtgaccaccaggggctctgaactgtagctgatgttatcagcaggccatgcatcctgctgccaagggtggacacggctgcagacttctgggggaattgtcgcctcctgctcttttgttactgagtgaga

SEQ ID NO: 1019 - DNA, 247 bp, Homo sapiens
ggaggagctgctccttccttacagccttggggatggacttgcccacacctccacctcccctgagccctgtgagaggcacgactgtctatgccaatgaggctcggtggggggctctcaagtgcctgatcctgccctgggctcagagccagcccagagggaagcaactgcacagccccacaggccctccctggcactgtccccccaaccccatctcagagctcagagggtacaagctccagaacagtaa

SEQ ID NO: 1020 - DNA, 277 bp, Homo sapiens
gttttcaattttgcatgctcgattattccctgtacaatatttaaaatttattgcttgatacttttgacaacaaattaggttttgtacaattgaacttaaataaatgtcattaaaataaataaatgcaatatgtattaatattcattgtataaaaatagaagaatacaaacatatttgttaaatatttacatatgaaatttaatatagctatttttatggaatttttcattgatatgaaaaatatgatattgcatatgcatagttcccatgttaaatc

SEQ ID NO: 1021 - DNA, 247 bp, Homo sapiens
aactgtagcaagatgcaaatgcatggcaaatctgtcggtctccagttggttatctgaatagtgtcaccaattccaccaagacagtgctgagattggaaagggcactcatttggattgccttacttctcttgccttaaatatatcccatatatttaatatgtcaaaaagggcttgaggtgaatttcattaaatggaataatatgatgccactttgcagctaaaataagctcagtgatacctccttgtt

SEQ ID NO: 1022 - DNA, 53 bp, Homo sapiens
acgaaagcgcaagaaatcccggtataagtcctggagcgttccctgtgggcctt

SEQ ID NO: 1023 - DNA, 131 bp, Homo sapiens
gctgctgcaatgacgagggcctggagtgtgtgcccactgaggagtccaacatcaccatgcagattatgcggatcaaacctcaccaaggccagcacataggagagatgagcttcctacagcacaacaaatgt

SEQ ID NO: 1024 - DNA, 271 bp, Homo sapiens
taaactgtgtctcgacctgtgttatttacattagctgcttaaaaaagcattgagttaatttttttaaatatcaactaaaatatcatagttctgtggtagacattgttttataatgaaataactgcaactagagaaaactgtataaaaacattaaattgtcagtatttttgtaaggttccattttgtaaagagaataatattcaaagacttttgtagcatacaaagtgaaaacttgtatctgcgaaactatacttgtattaaatgtgctttt

SEQ ID NO: 1025 - DNA, 77 bp, Homo sapiens
tactgtaactgtcagtgtacacgtctggaccccgtttcatttttacaccaatttggtaaaaatgctgctctcagcct

SEQ ID NO: 1026 - DNA, 233 bp, Homo sapiens
tcctaatctgtgtgtgccctgtaacctgactggttaacagcagtcctttgtaaacagtgttttaaactctcctagtcaatatccaccccatccaatttatcaaggaagaaatggttcagaaaatattttcagcctacagttatgttcagtcacacacacatacaaaatgttccttttgcttttaaagtaatttttgactcccagatcagtcagagcccctacagcattgttaa

SEQ ID NO: 1027 - DNA, 174 bp, Homo sapiens
atgctgtatgtgactatagatattcatataaaacaagtgcacgtgaagtttgcaaaatgctttaaggccttcctttcaaagcatagtccttttggagccgttttgtaccttttataccttggcttatttgaagttgacacatggggttagttactactctccatgtgcattggg

SEQ ID NO: 1028 - DNA, 272 bp, Homo sapiens
gtgccactttacccacctagaacactaactcaccagccccactgccagcagcagcaggtgattggaccaggccattctgccgccccctcctgaaccgcacagctcaggaggcgcccttggcttctgtgatgagctgatctgcggatctcagctttgagaagccttcagctccagggaatccaagcctccacagcgagggcagctgctatttattttcctaaagagagtatttttatacaaacctaccaaaatggaataaaaggcttgaagct

SEQ ID NO: 1029 - DNA, 220 bp, Homo sapiens
tcttctcacattaaggtggtggcttgccactcagcagtcctagcttggtgactgggaactgccacatacagggccaggcctaccctccttccccacaagccccctccaacccccacccccatgctctggacctcatggctcctatgagcttggagcatggtgaaccatcagagaatctagaaccaaccaagctaggaacatcagcctggtgccctgttaa

SEQ ID NO: 1030 - DNA, 212 bp, Homo sapiens
cagatattattgactacttcaggaaaatgccacttctgctcattgatgggaaaaaccgaggttccagataccagtgcacattaacgcatgctgcagggtacccatagcaagttatagccgagcaaatgaaccgtcctcctgcctctgttgccaacacgagatcaatcagccttggtcaatggacaaacacttaggactgaactgaacccctc

SEQ ID NO: 1031 - DNA, 224 bp, Homo sapiens
aaataagtcatgtgtcccagcataaggcatcaggttgttagatgctggcatctctgcagctcaaagatgtgggttctttttcttgtcattaacacattgttatttctgtaggaccaacttctctgatcaaaattacttttctgggtatgtgctgattaagggggtggacttatcaacactataattgttccctatgaaagattccacagagatgtttatggtga

SEQ ID NO: 1032 - DNA, 130 bp, Homo sapiens
ctgtttgcagcagtcaattgagttgaattagaattccaaccatacattttaaaggtatttgtgctgtgtgtatattttgataaaatgttgtgacttcatggcaaacaggtggatgtgtaaaaatggaata

SEQ ID NO: 1033 - DNA, 284 bp, Homo sapiens
aaggtttgctagacaccttcgcttgttatcttgtcaagatagaaaagatagtatcatttcacccttgccagtaaaaacctttccatccacccattctcagcagactccagtattggcacagtcactcactgccattctcacactataacaagaaaagaaatgaagtgcataagtctcctgggaaaagaaccttaaccccttctcgtgccatgactggtgatttcatgactcataagcccctccgtaggcatcattcaagatcaatggcccatgcatgctgtttg

SEQ ID NO: 1034 - DNA, 297 bp, Homo sapiens
gcgtttgattctgcccacagggcctgtgccaaggcaatcagatctttatgagagcagtattttctgtgttttctttttaatttacagcctttcttattttgatatttttttaatgttgtggatgaatgccagctttcagacagagcccacttagcttgtccacatggatctcaatgccaatcctccattcttcctctccagatatttttgggagtgacaaacattctctcatcctacttagcctacctagatttctcatgacgagttaatgcatgtccgtggttgggtgcacctgta

SEQ ID NO: 1035 - DNA, 32 bp, Homo sapiens
aacctttactttgactaccagcctgtgttttt

SEQ ID NO: 1036 - DNA, 286 bp, Homo sapiens
tttaaatgagcctgacacctgtgtttcagcatttggagacatccccatgttattcttttaagtgtataattactgatacttttttgtttgtttgtttaactaagttgtgtttaacttatgtgcagtctttataatgtatgtatgttattacagtttcaactatcatattttctttgattacatttataatttgatcttgctctgattataatgccagtgaatgttgctgaactctttgtatatgcaaattgcaagatttaaaccattctgatgcaaggataaacct

SEQ ID NO: 1037 - DNA, 202 bp, Homo sapiens
caacacaataacactttctgtataaaagtatatattttatgtgatttattcctactaaatgaaagtgcactactgcctcatgtaaagactcttgcacgcagagcctttaagtgactaaggaacaacatagatagtgagcatagtccccacctccacccctcacaatttatttgaatacttcaattgtgcctctcaatttttt

SEQ ID NO: 1038 - DNA, 191 bp, Homo sapiens
atcgcaccaccgcatgagagagagagattactatttcttgtccctttttctcagtttgattatatttatatacatatgtcagtaaatctgttttcagtattgatgtttaataaagaatgtacaatggccagagttctactctttcctctggagcattaaaatatattgccattcctattaaaacgtatttg

SEQ ID NO: 1039 - DNA, 34 bp, Homo sapiens
tatgtgcctatcctaataaactcttaaacacatt

SEQ ID NO: 1040 - DNA, 185 bp, Homo sapiens
caaatttgtttgactaattctggaattacaagatttctatgcaggatttaccttcatcctgtgcatgtttcccaaactgtgaggagggaaggctcagagatcgagcttctcctctgagttctaacaaaatggtgctttgagggtcagcctttaggaaggtgcagctttgttgtcctttgagcttt

SEQ ID NO: 1041 - DNA, 214 bp, Homo sapiens
gcaagggaaagttaccctgatcttagtttgtagcttatgacttatttaatgaatggatgcccagccaagctcagagtaggcgcccaaagcattgtggattattttcctgttttgtctttttttttttttttttttaagccatgacatcccagaagaggacagtgaattactcctaggtcggctcttatagagtggccatagtgttctgtcaaaa

SEQ ID NO: 1042 - DNA, 139 bp, Homo sapiens
cattactggtgggatctggtcacacaagatagcattaaacgtgacatggcacataaaattggttaaaaaattttgttttttaattacgtaatgtaaaagcccaacaaacactttatgcaagattggaatgtatcttcaa

SEQ ID NO: 1043 - DNA, 293 bp, Homo sapiens
ctccttttcagggatgtcgtgggcgggggagggggttcttggtgctacagccctctccccacccctaaagggacgccgacgctgtttgctgccttcaccacatattagtgcttgaccctggcaggggaccccatggaaaagatggggaagagcaaaatacatggagacgacgcaccctccaggatgctcgctgggattcccacgcccaccactgtcccccaccccatggctgggaggggcctctgaacggaacagtgtccccacagagcgaataaagccaaggcttcttccca

SEQ ID NO: 1044 - DNA, 235 bp, Homo sapiens
gaagccaaggctatttaatctcacttgtatcactccaaatgaagtgttttccttgcttttcgggggtacaacgtctattttttgcctttcttgatatctggagatttctagagtggatctcttatgaatgaggaggaatgtggaaagtttcacatttagttagaagaactttaaaaaattggtttctaactagactacctttactgaacttaatgaaatttagcagattcttctt

SEQ ID NO: 1045 - DNA, 225 bp, Homo sapiens
tgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaa

SEQ ID NO: 1046 - DNA, 130 bp, Homo sapiens
ttaattggaaggaacacgtgagttgaagccctggccgattaccccttcccggagtctaataaaagggtattaatcacaagaaaaagaaaagagcgaaaagagacggagaacatgcgagaaaggacgacag

SEQ ID NO: 1047 - DNA, 111 bp, Homo sapiens
tactcggagaccgactcgcaggcgtcccgagagcgcaggctcaagaagaacttggccctgagtcgggaaagtttagtcgtctgatctgacgttttctacgtagcttttgta

SEQ ID NO: 1048 - DNA, 233 bp, Homo sapiens
tacaaactgacattgtctactatacatttttaaaagccattttactggtttggcatgcggtatggaaattctaagagagaaagttttaaggcaatgaatcacagatttaagttcatggaatttatggtaactttatctgtttatgtacattttcccctttgttaaacaattaacagcagcacactctgggaccaccagctattttccctctctttctgaaatctaagctttgt

SEQ ID NO: 1049 - DNA, 282 bp, Homo sapiens
gtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtcttccatttggataaaaggaaccaaccaacaaacaatgccatcactggaatttcccaccgctttgtgagccgtgtcgtatgacctagtaaactttgtacca

SEQ ID NO: 1050 - DNA, 135 bp, Homo sapiens
tggtggccaccgtgtcccttgctgcggctgcatcttccagtctctcctccgtcttccagtggccgctctctttataagaaccctggtcattgaatttaaggcccaccccaagtccagaatgacctcgcaagaccc

SEQ ID NO: 1051 - DNA, 223 bp, Homo sapiens
agataagtatcaggtctgaccccagtggaaaacaaagccaaacaaaactgaaccacaaaaaaaaaggctggtgttcaccaaaaccaaacttgttcatttagataatttgaaaaagttccatagaaaaggcgtgcagtactaagggaacaatccatgtgattaatgttttcattatgttcatgtaagaagccccttatttttagccataattttgcatactgaa

SEQ ID NO: 1052 - DNA, 237 bp, Homo sapiens
caggtaccacggctcacgcctgtatcccagcactttggaaggctgaggcgggtggatcacaaggtcaggagttcaagaccagcctggccaacatggtgtaacgctgtctctactaaaaatacaaaaaattagccaggcatggtggtgtgtgactataatcccagctactcgggaggctgagacaggagaatcacttgaacccgggaggtggcagttgcagggagctaagatcgcgcc

SEQ ID NO: 1053 - DNA, 156 bp, Homo sapiens
acattatacttcatggtgatagactgaaggctgaatgttttccccttaagattgggaagaaggacaaggatgttcactcggcactacttctattcagcattgtacttgaagttctagccacagcagttaggttaggaattcaaggtttgttcaaca

SEQ ID NO: 1054 - DNA, 284 bp, Homo sapiens
aacagttggcatggaggctgcgactgatgaaggcatgcctaaaagttacttaccacagactgtacggcaaggcggctacatgcctcagtgaaggactagtagttcctgctacaacttcagcagtacctataaagtaaagctaaaatgattttatctgtgaattcagattttaaaaagtcttcactctctgaagatgatcatttgcccttaaggacaaaaatgaactgaagtttcacatgagctatttccattccagaatatctgggattctactttaagcacta

SEQ ID NO: 1055 - DNA, 168 bp, Homo sapiens
accaccatcaccagacaggtgcgaaaggatgaaagtgaccatgttttgtttacggttttccaggtttaagctgttactgtcttcagtaagccgtgattttcattgctgggcttgtctgtagattttagaccctattgctgcttgaggcaactcatcttaggttggcaa

SEQ ID NO: 1056 - DNA, 220 bp, Homo sapiens
aacaaagttgttgagccttgcttcttccgttttgccctttgtctcgctccttattctttttatggggggagggttatttgcttttttatcttcctggcataatttccattttattcttctgagtgtctatgttaacttccctctatcccgcttataaaaaaattctccaacaaaaatacttgttgacttgatgttttatcacttctctaagtaaggttga

SEQ ID NO: 1057 - DNA, 231 bp, Homo sapiens
atgtacttagagctttttgagtgtagaattttaaatggcaggattttacagtgtttacatgcaagtgcattttataagtgttctatatgtgtaaaatagtattttcaactggaaagtgttggctagtgcaaaaggcctggccattttctggttcccatgatgttgcctacactgctagactacagtttagtatcgctttgtatcatgaggccaagaaattccatgttgttt

SEQ ID NO: 1058 - DNA, 244 bp, Homo sapiens
cgactttgaggaatccggctgagtgggggaggggaagcaagaagggatgggggtcaagctgctctctcttcccagtgcagatccactcatcagcagagccagattgtgccaactatccaaaaacttagatgagcagaatgacaaaaaaaaaaaaggccaatgagaactcaactcctggctcctgggactgcaccagactgctccaaactcacctcactggcttctgtgtcccaagactaggttg

SEQ ID NO: 1059 - DNA, 194 bp, Homo sapiens
gggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgta

SEQ ID NO: 1060 - DNA, 213 bp, Homo sapiens
tttgtgtgtttttagctgtgacacaactgtgtgattaaaaggtatactttagtagacatttataactcaaggataccttcttatttaatcttttcttatttttgtactttatcatgaatgcttttagtgtgtgcataatagctacagtgcatagttgtagacaaagtacattctggggaaacaacatttatatgtagcctttactgtttgata

SEQ ID NO: 1061 - DNA, 244 bp, Homo sapiens
ctagctataaggctataattggaaatttgtattttttatttacagcaaaacatttattcagtcatccagtttgctaccaaaatatgttttagataagtgtgtgtatgtttgtttagaagttagaaattgtaaacactggtcttatgtttcatttggattcattattgcattgtcttgttaccagaaacaaattttgccgagctttttttgccctatatttcccagcataatttgattagaaagt

SEQ ID NO: 1062 - DNA, 257 bp, Homo sapiens
tccaggaaactgaacactgagatctgactgcgtcacctgccccgtagagaatgtgtgtagatacttcctgccctaactctgcccaccctcctgtaccgtcgacaagaatgtccccttaggtcgcgctcttgcacacacggttttggcagctgacttggttctgaagccatgtagccacccaactttgtcattttcaacaacatcagaaagaattgatcagaatcccaaataaaacccaaaagtgtctaatgtattca

SEQ ID NO: 1063 - DNA, 244 bp, Homo sapiens
ggagccttagaggtctttaatcattggttcggctgcttttatgtagtttaggctggaaatggtttcacttgctctttgactgtcagcaagactgaagatggcttttcctggacagctagaaaacacaaaatcttgtaggtcattgcacctatctcagccataggtgcagtttgcttctacatgatgctaaaggctgcgaatgggatcctgatggaactaaggactccaatgtcgaactcttctt

SEQ ID NO: 1064 - DNA, 111 bp, Homo sapiens
gaagtacgtcccagcggcctcagggtctaaggagcgctagtgccttgcccacaggtgcgggaccatctgatgtgatgtgaatactcttcccacatacattaaacacactta

SEQ ID NO: 1065 - DNA, 262 bp, Homo sapiens
gggaattcgttcacaaatgtactgataccacagatgtgggcaggggctaggagagcaacagggtgcagcctgaaggcacctggaaggccgcctggagggggacagtcaggaaagcaggagcccttgagaggagcactagcctttgatgagaccactgccatcgaaggagacctcacagggagggagccaagggtaaaccctaactttgtttccccatttctcctatctctgcctaggggtcctcactggcagaaccaaccag

SEQ ID NO: 1066 - DNA, 213 bp, Homo sapiens
tcccatacaggctcttacctcttctcctgagggctgctccagacaacatttattacccagaagaccttttgtctgaaaaccagccaagctttattcaggacacacttcttgccttcactttcccacttccgtggccacctccatgcagaagccctaagcccacattctttcgatagctcacggtggtgcatgagtgtccatcatctgactctt

SEQ ID NO: 1067 - DNA, 244 bp, Homo sapiens
gggtctgccacatgtagaaagatatcttccaaaacgaaatcctccagcatcattggatccagttcagcctcacatacttctcaagcgacatcaggagccaatagcaaattggggattatggctccaccgaagcctataaatagaccgtttcttaagccttcatatgcattctcataacaaccgaatctcaatgtacatagaccctctttcttgtttgtcagcatctgaccatctgtgactataa

SEQ ID NO: 1068 - DNA, 228 bp, Homo sapiens
atgatgaataagttggttctagcgcagttttttttttcttgtctataaagcatttaacccccctgtacacaactcactccttttaaagaaaaaaattgaaatgtaaggctgtgtaagatttgtttttaaactgtacagtgtctttttttgtatagttaacacactaccgaatgtgtctttagatagccctgtcctggtggtattttcaatagccactaaccttgcctg

SEQ ID NO: 1069 - DNA, 82 bp, Homo sapiens
tgaagatgcccctatgataactggattttcagatgacgtccccatggtgatagcctgaaagagctttcctcactagaaacca

SEQ ID NO: 1070 - DNA, 282 bp, Homo sapiens
ttctggaagcatggagtgcaggtgtgggctctaggctcggatcagctgctacaggagctgagagaccctaccctcactttccgtctgcttggctcccccaggcctgtagtggtggagacacgcccagtggatgatcctactgctcccagcaacctctacatccaggaatgagtccctaggggggtgtcaggaactagtccttgcaccccctcccccatagacacactagtggtcatggcatgtcctcatctcccaataaacatgactttagcctctgcaaaa

SEQ ID NO: 1071 - DNA, 269 bp, Homo sapiens
ttggtcattatagtatatgcctaaaatgtatgcacttaggaatgctaaaaatttaaatatggtctaaagcaaataaaagcaaagaggaaaaactttggacatcgtaaagactagaatagtcttttaaaaagaaagccagtatattggtttgaaatatagagatgtgtcccaatttcaagtattttaattgcaccttaatgaaattatctattttctatagattttagtactattgaatgtattactttactgttacctgaatttattat

SEQ ID NO: 1072 - DNA, 80 bp, Homo sapiens
tttttctgtctatcaaaactatttgatccaagtgaaaaaaaaaaaaaaactagaaagctacggaacctgcaatgcggccg

SEQ ID NO: 1073 - DNA, 296 bp, Homo sapiens
tggacgttggactgttcatgcgcatcgggtgtcagtgactcatggagaagaaatggggtaaatttttagtgatgttgctaatcattgaattctgttctctattaaattaagaaaatgttccaaaagccataagcctgaagattggccctgtgcacgcacgcacacacacacacacacacacacacacacacacacacacgaaggagagagagagaaaactgatggggaaaacaagctgtgtcttcttaactgcccaagtgaaaagcaaccaagtccaggaaattacaatagctgtt

SEQ ID NO: 1074 - DNA, 53 bp, Homo sapiens
taaacagtcactggaaagagtgccagtcagcagtcatgcacgctgataaaaaa

SEQ ID NO: 1075 - DNA, 219 bp, Homo sapiens
tcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagt

SEQ ID NO: 1076 - DNA, 37 bp, Homo sapiens
gggaattcatggattattaaggtccttcaggcccttg

SEQ ID NO: 1077 - DNA, 295 bp, Homo sapiens
tgatactgcccaccatacagaagtccttactgaggagtccagagaatgttattgaaactatttctagtctgctggcatcagtgacgcttgacctcagccagtatgccatggacatcgtgaaaggactggctggtcacctgaaatccaacagtccccgcctgatggatgaagctgtgctggcactgcggaacctggcacgccagtgcagtgactcttcggccatggagtccctgaccaagcacctatttgctatcctcggaggctcggaaggaaaactaactgttgtagcccagaa

SEQ ID NO: 1078 - DNA, 168 bp, Homo sapiens
aaagtgtctttttacctacgcagtgaaatgtcagactgtaaaaccttgtgtggaaatgtttaacttttattttttcatttaaatttgctgttctggtattaccaaaccacacatttgtaccgaattggcagtaaatgttagccatttacagcaatgccaaatatggag

SEQ ID NO: 1079 - DNA, 292 bp, Homo sapiens
caaaggcgaggctggatttttcggaatacccggtctgaagggtctggctggtgagccaggttttaaaggcagccgaggggaccctgggcccccaggaccacctcctgtcatcctgccaggaatgaaagacattaaaggagagaaaggagatgaagggcctatggggctgaaaggatacctgggcgcaaaaggtatccaaggaatgccaggcatcccagggctgtcaggaatccctgggctgcctgggaggcccggccacatcaaaggagtcaagggagacatcggagtccct

SEQ ID NO: 1080 - DNA, 36 bp, Homo sapiens
gccctggagtaggcgagccagccgccaaggttgacc

SEQ ID NO: 1081 - DNA, 208 bp, Homo sapiens
ccacctccaaatactttgtgagcagcggttccatcgcagtgaacgccgactcttcggtgcagttgttggccgaagaggccgtgacgctggacatgttggacctgggggcagccaaggcaaacttggagaaggcccaggcggagctggtggggacagctgacgaggccacgcgggcagagatccagatccgaatcgaggccaacgaggc

SEQ ID NO: 1082 - DNA, 142 bp, Homo sapiens
ctgggcggtcatggcgctactagatgtatgcggagccccccgagggcagcggccggaatcggctctcccggttgcgggaagcgggcgtcgctcggacccaggacactacagtttctctatgcgatctccagagctcgcttta

SEQ ID NO: 1083 - DNA, 122 bp, Homo sapiens
taagatgtttcttgagtctcctgtgtatatttcttttccacagttggctgagtgccttcgtgagagtacaaggcccgaagggtagtgatggtgctaaactcaacatggatttggctgagctc

SEQ ID NO: 1084 - skipped

SEQ ID NO: 1085 - DNA, 81 bp, Homo sapiens
taaaggctttgatttaatcttgatataaacagatttttaaaaatctccacccattaaacatgaagcttcctgcatcaggaa

SEQ ID NO: 1086 - DNA, 226 bp, Homo sapiens
tcttctcctgtgcttgagctctggtttgagagctggcgctaccaacctttttcctatatcccgagtggggcacagacggtggatctctgcccagtgtggtgtgtctggcttggcttttcaatattgtgaggtctgaatggatctgatccctgtcagatgaaaatgattcacagctctggcagttcccaagtctggggaggggtataggtttgaaaggctgtttgaa

SEQ ID NO: 1087 - DNA, 36 bp, Homo sapiens
tttaataaaagtgacccatgatatgcagagatgtaa

SEQ ID NO: 1088 - DNA, 212 bp, Homo sapiens
ggtcttgtaatgcactggtaaaaacaaaataaatagatgaataaataaagagtgagagaagagagaatcaggtaccttttttaaattaaaggactttgttactttagccacaaagctaaaacagcattacctcagctctaaactagccttgaagtttacagacatgactttgtaaatgtattgtttttctttgttgtgatgtccttttattt

SEQ ID NO: 1089 - DNA, 276 bp, Homo sapiens
aacagccatcttttcagcagttgccaacctgtcctccactgcagcctcacccgggcttgcaccaccagtcttcacctccacaccctcatcaccagccttgggcacagctccacccatcaccccagaacaccccgcagaaagtgcctgtgcatcagcattccccgtcggagccctttctagagaaaccagcgccggatatgactcacgttagtggaccgaatgctcagctagtgaagagtgatgattacctgccatcaatagaacagcagccacaac

SEQ ID NO: 1090 - DNA, 245 bp, Homo sapiens
cactctgggaggctgtgttgggccgatcgcttgagctcatgagttcaagaccaacctgggcaacatggcaaaaccttgtctctacaaaaaatacaaaaattagccaggcatggtggtgcacacctgtagtcccagctacttgggaggcttaggtgggaggatggcttgagcacgggaggcagaggttgcactaagccaagatcgtgtcactgcactccagcccaggcaatagagccagaccctgt

SEQ ID NO: 1091 - DNA, 290 bp, Homo sapiens
tccattgggtgggttcttttgtacaccttctgtttctttgcttattttttaacgccaaagaaagactctcagagaatagacaactatattccaaagtcatggttctctggtggtttgtcttgacatttgaatagaaatgttaaactatctgggggaatagaaagcccacagtcttctgagttgtgctacaccaatatttctatgaacagatcttacaactgagagtgatctgcagatttttcagagtcatgttctccatggaaatgtttgtaaaattccctagctctctg

SEQ ID NO: 1092 - DNA, 212 bp, Homo sapiens
tattttttctgattgtggttcagtttaactgaagaatatcctgagattgtaagaaaagcattttttaaaaggtatcacttgtgatcatttatctttctaaattctatttttaatactgttccaccaaagtgatgcagtggttaccatgacaccctaatttcatgtgtttttgtatttatgaaaatagtttcattgtcatttattggcggtat

SEQ ID NO: 1093 - DNA, 244 bp, Homo sapiens
tacaagcctctatgtaaagcacaggctggtgagggccccaggaagagcagcaccgccctcggcacaggcccctactccaagtcctgtgcaggagcaggtcttgcccagcgcagcagctctgcacctctgtggcaccgctctgccaagagggaaggtgcaggccctgcagcccatcgccttggatctgaagaccagccctgtggggctgctaagtcatgaaactggcctcatggagatttcataa

SEQ ID NO: 1094 - DNA, 114 bp, Homo sapiens
tccagcactggaaagaagtggtcttgagcccagctgagaagcacttcacactcctctctcttgttctgaatggtgtttgtgtcagtctgcagctgtgtatggtattatgtctta

SEQ ID NO: 1095 - DNA, 242 bp, Homo sapiens
attaccatcgattcagtgcctggataaagaggaaagcttacttgtttaatggcagccacatgcacgaagatgctaagaagaaaaagaattccaaatcctcaacttttgaggtttcggctctccaatttaactctttggcaacaggaaacaggttttgcaagttcaaggttcactccctatatgtgattataggaattgtttgtggaaatggattaacatacccgtctatgcctaaaagataa

SEQ ID NO: 1096 - DNA, 207 bp, Homo sapiens
gtctttgcagactacgaagcctatgtcaagtgtcaagataaagtgagtcagctgtacatgaatccaaaggcctggaacacaatggtactcaaaaacatagctgcctcggggaaattctccagtgaccgaacaattaaagaatatgcccaaaacatctggaacgtggaaccttcagatctaaagatttctctatccaatgaatctaac

SEQ ID NO: 1097 - DNA, 285 bp, Homo sapiens
tattgagccagcagctgttgtacctgttacacttgtgcagaaagattttaatgtggggggtgggagacttttacatttgagaggtaaaagtattttttttatgaagttgtgtatcttaataaaaagaactgaattagtttttattactatattaaagcatcaacatttcatgccacataaaattatatttaataagaaccagattgaaatgagaacgtattggtgtttgtacagtgaacatgccacctttttccatggtttcaggtagtgcagctaccacatgtt

SEQ ID NO: 1098 - DNA, 205 bp, Homo sapiens
tacacctgtgtgcacctgtattactgaatataggaaagagatacccattacatagttactcagtaaacaaaaagagaaataccaggtaggaaagaagagttactattcctgagaaataatcaagaacatatttaatttaaactaatgatgtgaactatttagttttgatgtccgttatgtgattctgcttttacttgagtaaaat

SEQ ID NO: 1099 - DNA, 112 bp, Homo sapiens
cccagaactgcagcatcatgtaatctgggacctgccaggcaggggtgggggtggaggcttcctgcgtcctcctcacctcatgcccaccccctgccctgcacgtcatgggagg

SEQ ID NO: 1100 - DNA, 248 bp, Homo sapiens
cttgtatagtgtccccatgggctcccactgcagcctcgagtgcccctgtcccacctggctccccctgctggtgtctagtgtttttttccctctcctgtccttgtgttgaaggcagtaaactaagggtgtcaagccccattccctctctactcttgacagcaggattggatgttgtgtattgtggtttattttattttcttcattttgttctgaaattaaagtatgcaaaaataaagaatatgccgttt

SEQ ID NO: 1101 - DNA, 223 bp, Homo sapiens
agaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctg

SEQ ID NO: 1102 - DNA, 105 bp, Homo sapiens
tgatcgagcctcgagagagagccaagttcaaacgcaagtactaggtgaagctgggtggagaagcgggcgttccgtgagatccagttgtagctgccatcagatgcc

SEQ ID NO: 1103 - DNA, 173 bp, Homo sapiens
cttgtcccctcttaaagagcagttgtcaccacctgaacaccaaggcattgtattttcatgcccagttaacttatttacaatatttaagttctctgcttctgcatttggttggtttcctgaagcgcagcccctgtgaataacaggtggcttttcatggatgtctctagtcagag

SEQ ID NO: 1104 - DNA, 195 bp, Homo sapiens
tcaacagtcgaagaaggtgtgggcagaagaaaaagctagtgatcaacagtggcaatggagctgtggaggacagaaagccaagtggactcaacggagaggccagcaagtctcaggaaatggtgcatttggtgaacaaggagtcgtcagaaactccagaccagtttatgacagctgatgagacaaggaacctgcaga

SEQ ID NO: 1105 - DNA, 86 bp, Homo sapiens
tgatcaaatgcaacctcacaaccttggctgagtcttgagactgaaagatttagccataatgtaaactgcctcaaattggactttgg

SEQ ID NO: 1106 - DNA, 218 bp, Homo sapiens
gtggtcccagccagtttggtgctgacggtgagaggaaattagaatctgtttgcaaattgtccaacccaccccctcaacatgaggggcttccattttctgtgttttgtaagggaactgtttccttcatgccgccatgttcctgatattagttctgatttctttttaacaaatgttatcatgattaagaaaatttccagcactttaatggccaattaact

SEQ ID NO: 1107 - DNA, 139 bp, Homo sapiens
  misc_feature (45)..(58): n is a, c, g, or t
gttcattttggatgctggtgctaaacctccaagtgtcatgatttnnnnnnnnnnnnnntttatgtccttcttatttatttctaggatgaggggaggaaaacatttttgctttcttatgtgactctctttgaaaatgtgc

SEQ ID NO: 1108 - DNA, 269 bp, Homo sapiens
aagtgcctctttgtctatgatgtcccccttctctgaggcctggacccacccatctttgtccctggggcctgctcccagccactgaggcccgctctgccaggggagaaggagctgccgtgcgtcttccctgtgccccgtctccctgcttggttctcccctcccttccctggccggctgccatggccaggagctaagtgcctttttgtgtgcaaccacttaccctttctctgaaaaacctgttctcaggaaggatctgataaactcattta

SEQ ID NO: 1109 - DNA, 293 bp, Homo sapiens
acatccctcaggcatgtattctggaaatggaattcctgtaacttcctgtgtctgcagtatgccctacaattagtaggcagcgtgtaaaaacactagtgtagattataaagatatacattaaaagaggaccagaaatacttggtattcagtggcacagaaagcaggttaaacaaacaaaaagcacagtgttacgcttgcaagtttccatttgttttaataccacgcaatctttcacactcgtgcgtgtgcgcgcacacagagcttacctgacttgctctgcttgagtcatgcag

SEQ ID NO: 1110 - DNA, 218 bp, Homo sapiens
cttgattttaaagatcgtgtagattggggttggggagggatgaagggcgagtgaatttaaggataatgaaataatcagtgactgaaaccattttcccatcatcctttgttttgagcattcgctgtaccctttaagatatccatctttttctttttaaccctaatctttcacttgaaagattttattgtataaaaagtttcacaggtcaataaaattag

SEQ ID NO: 1111 - DNA, 214 bp, Homo sapiens
gtatttatcacttggacatctgtttataatataaacagacatgtgactgggaacatcttgctgccaaaagaatcctaggcagtggctcattgtatgtgaggttgaaccacgtgaaattgccaatattaggctggcttttatctacaaagaaggagtttcatggggttcagcctaacagttatggaaactacagtccttataaaccattggcatg

SEQ ID NO: 1112 - DNA, 165 bp, Homo sapiens
agtgaatagtcaaaaatcctgttagcaaactgttatatattgctaagtttgttcttttaacagctggaatttattaagatgcattattttgattttattcactgcctaaaacactttgggtggtattgatggagttggtggattttcctccaagtgattaaatga

SEQ ID NO: 1113 - DNA, 199 bp, Homo sapiens
ttctttgtcagttaaaagtgaacagtgagaattaaatacttatctttacatatacacaaggtatgctatgaaagcatatctgcttacaaacatataaaaatacttgttaactagtttgataagaaaataatgtataaaagtatatagcaaaaacattaatcatctctgaccctggaaagatcaattccatattttatat

SEQ ID NO: 1114 - DNA, 282 bp, Homo sapiens
tcgcggcccgtagataacgcgtgtagctccatcttggacgccaccatccgtgtggtcatctcggcgtccgcggctactccagccccacagcagtagattttgggggcgatgaagtggatcttctcgcagctcttgtccgccacgaccgaatcgttagtggctcgcgtatcggcgcccagaatgacccccgtcttggaacaccaagcccgcgatggtggtcccggtcttgcgtgcgtgaagggaccttgagccccgggaggacgcgttccaatgatgcatttt

SEQ ID NO: 1115 - DNA, 154 bp, Homo sapiens
agtccacgttcacaaaatgtgaaggtgtggagacacttacaaagctgcctcacttctcactgtaaacattagctctttccactgcctacctggaccccagtctaggaattaaatctgcacctaaccaaggtcccttgtaagaaatgtccattca

SEQ ID NO: 1116 - DNA, 161 bp, Homo sapiens
gatggtgggatatttgtgtctgtgttcttataatatattattattcttccttggttctagaaaaatagataaatatatttttttcaggaaatagtgtggtgtttccagtttgatgttgctgggtggttgagtgagtgaattttcatgtggctgggtgggtt

SEQ ID NO: 1117 - DNA, 294 bp, Homo sapiens
cggaactcgatgagcccctgcgcgggcagcgcaatggtctggccctgcgtggagcccaggccaggcccccggttgaccgtctggcggatgcgcaggaagcggccgcgctggttctccttgagatccatgtagtacttgcggttctcgcgcaccaggaactcgcttttgagcgcccggcgcggctcgtcctgcgcctgggccaggtccggcggctggctggggcccagctgcgcgtagtgctcgatgaagtcgcccaggtagtcgcggaactccacggccactgacatggaaaga

SEQ ID NO: 1118 - DNA, 293 bp, Homo sapiens
cggaactcgatgagcccctgcgcgggcagcgcaatggtctggccctgcgtggagcccaggccaggcccccggttgaccgtctggcggatgcgcaggaagcggccgcgctggttctccttgagatccatgtagtacttgcggttctcgcgcaccaggaactcgcttttgagcgcccggcgcggctcgtcctgcgcctgggccaggtccggcggctggctggggcccagctgcgcgtagtgctcgatgaagtcgcccaggtagtcgcggaactccacggccactgacatggaaag

SEQ ID NO: 1119 - DNA, 255 bp, Homo sapiens
attgcgagcggcatctacctactggcggctgtgcgtggcgagcagtggacgcccatcgagcccaagccccgggagcggccgcagatcggaggcaccatcaagcagccgcccagcaaccccccgccgcggcccccggccgaggcccgcaagaagcccagcgaggaggaggctgcggtggcggcggggggacccccgggaggtccccaggtcaaccccatcccggtgaccgacgaggtcgtgtgacctcgccccgga

SEQ ID NO: 1120 - DNA, 205 bp, Homo sapiens
tggcccagcgccaagtaaacagggtacctcaagccccatttcctcacactaagagggcagactgtgaacttgactgggtgagacccaaagcggtccctgtccctctagtgccttctttagaccctcgggccccatcctcatccctgactggccaaacccttgctttcctgggcctttgcaagatgcttggttgtgttgaggtttt

SEQ ID NO: 1121 - DNA, 229 bp, Homo sapiens
aactggacaccaacagtgatggtcagctagatttctcagaatttcttaatctgattggtggcctagctatggcttgccatgactccttcctcaaggctgtcccttcccagaagcggacctgaggaccccttggccctggccttcaaacccaccccctttccttccagcctttctgtcatcatctccacagcccacccatcccctgagcacactaaccacctcatgcagg

SEQ ID NO: 1122 - DNA, 219 bp, Homo sapiens
tttggaagccacaaaatagacagacaccctgactgttgaagggaggtttaaaaacagatattcaattgaaatgtaagagagcacctcaattgagagcccaggttacgaagacaagcttgcctcgcctgacttttctgtcccttgttctgcaggattagtattctgttacagacttctagttttagactcttcattaaagggccaatggttataacctgc

SEQ ID NO: 1123 - DNA, 246 bp, Homo sapiens
atctataaaattgctatatcctcctgatagccatgggaaaacatgataagatggtcatttattttgcagttagaattttggaagccacaaaatagacagacaccctgactgttgaagggaggtttaaaaacagatattcaattgaaatgtaagagagcacctcaattgagagcccaggttacgaagacaagcttgcctcgcctgacttttctgtcccttgttctgcaggattagtattctgttaca

SEQ ID NO: 1124 - DNA, 108 bp, Homo sapiens
agtcaaatgcatgccaacattccagttttttaagaagggacaaaaggtgggtgaattttctggagccaataaggaaaagcttgaagccaccattaatgaattagtcta

SEQ ID NO: 1125 - DNA, 187 bp, Homo sapiens
agctctgtgaggacattatccaactgaagcccgatgtggtcatcactgaaaagggcatctcagatttagctcagcactaccttatgcgggccaatatcacagcccatccgcagagtccggaagacagacaataatcgcattgctagagcctgtggggccccggatagtcgccgaccagaggaactga

SEQ ID NO: 1126 - DNA, 256 bp, Homo sapiens
  misc_feature (74)..(106): n is a, c, g, or t
gggtgtaggtttctgaggtgtgccattggggcctcagccttctctggtgacagaggctcagctgtggccaccannnnnnnnnnnnnnnnnnnnnnnnnnnnnnnnnaatgggggcaaccacatccagtacaagcttttacaaatgttattagtgtccttttttatttctaatgccttgtcctcttaaaagttattttatttgttattattatttgttcttgactgttaattgtgaatggtaatgcaataaagtgcc

SEQ ID NO: 1127 - DNA, 218 bp, Homo sapiens
gggcccatggattaacgccctcatcccaaggtccgtcccatgacataacactccacacccgccccagccaacttcatgggtcactttttctggaaaataatgatctgtacagacaggacagaatgaaactcctgcggctctttggcctgaaagttgggaatggttggggagagaaggcagcagcttattggtggtcttttcaccattggcagaaacag

SEQ ID NO: 1128 - DNA, 249 bp, Homo sapiens
aaaaaattgtagatgcttgctttttgttttttcaatcatggccatattatgaaaatactaacaggatataggacaaggtgtaaatttttttattattattttaacagatatgatttatcctgagtgctgtatctattactcttttactttggttcctgttgtgctcttgtaaaaagaaaaatataaatttcctgaagaataaaatagatatatggcacttggagtgcatcatagttctacagtttgttt

SEQ ID NO: 1129 - DNA, 300 bp, Homo sapiens
ttccagacaaaggttttctctttcatgtatttacacaagttcaaaatgatattcacagcatcttctaaattttggccaagagtcaaaaaaatgcatttaaactttggaacgtgcccacataagacaggaggctgatcccaacagtagttggggcagatacccacaaaccaaagggctgggaaagtcaggaagagttgaaaggattcttcagtcagtttatgaactcggtgcagtgagacctctagactgacacgtacaacagagatgcagtttcgtctaactggcacctgtcccttcgga

SEQ ID NO: 1130 - DNA, 277 bp, Homo sapiens
  misc_feature (211)..(234): n is a, c, g, or t
gatgctatatgatacaactgtggccatgactgaggaaaggagctcacgcccagagactgggctgctctcccggaggccaaacccaagaaggtctggcaaagtcaggctcagggagactctgccctgctgcagacctcggtgtggacacacgctgcatagagctctccttgaaaacagaggggtctcaagacattctgcctacctattagcnnnnnnnnnnnnnnnnnnnnnnnnggggggaaaagtatttttgagaagtttgtcttgcaatgtattt

SEQ ID NO: 1131 - DNA, 36 bp, Homo sapiens
ggaaagagcaactgaagtcctagaaaatagaaatgt

SEQ ID NO: 1132 - DNA, 265 bp, Homo sapiens
atgcacccagctgtgccaagtgcaagaagaagattacaggcgagatcatgcacgccctgaagatgacctggcacgtgcactgctttacctgtgctgcctgcaagacgcccatccggaacagggccttctacatggaggagggcgtgccctattgcgagcgagactatgagaagatgtttggcacgaaatgccatggctgtgacttcaagatcgacgctggggaccgcttcctggaggccctgggcttcagctggcatgacacctg

SEQ ID NO: 1133 - DNA, 295 bp, Homo sapiens
acctgagagaacagattcttcgagttaaagacactgatgatgttccaatgattcttgttggtaataagtgtgacttggaagatgaaagagttgtagggaaggaacaaggtcaaaatctagcaagacaatggaacaactgtgcattcttagaatcttctgcaaaatcaaaaataaatgttaatgagatcttttatgacctagtgcggcaaattaacagaaaaactccagtgcccgggaaggctcgcaaaagtcatcatgtcagctgcttaatatactaaatgcattgtagctctga

SEQ ID NO: 1134 - DNA, 248 bp, Homo sapiens
tctaggttggctgctgtgtcatctttgaagtcaagacaaagctgggctcgaccttcaagggtcctcgttttgataatacttcagaatagggaactcatgtgaatactactatgtagaaataaaacctagaccttgagcgaacatctgtatattggttgaaaacgatagtggtaaccattgatcccccttcatttgatgtttggaaaattccagtaattatcatttttgcaacgaatatggataccaca

SEQ ID NO: 1135 - DNA, 53 bp, Homo sapiens
cttttctttttcagtgcagaaataaaagtaaataataagcacggtgattggga

SEQ ID NO: 1136 - DNA, 186 bp, Homo sapiens
cattgtcagattttgtgcttgattttaagaatggaattgtgggtatctttcctttttttttaatgtatcttaactgttgcctgtcagtgtttacaaactagtgcgttgacggcaccgtgtccaagtttttagaacccttgttagccagaccgaggtgtcctggtcaccgtttcaccatcatgcttt

SEQ ID NO: 1137 - DNA, 56 bp, Homo sapiens
tttgttgacagatgcaccaccagggaatactgacaccgatgatctcataccaaggt

SEQ ID NO: 1138 - DNA, 86 bp, Homo sapiens
gattgccccagctgatggaagtagtgcgatccaactatgaagcaatgattgatcgtgctcatggaggcccaaactttatgatgcat

SEQ ID NO: 1139 - DNA, 279 bp, Homo sapiens
gattgccccagctgatggaagtagtgcgatccaactatgaagcaatgattgatcgtgctcatggaggcccaaactttatgatgcattctgggatctctcaagcctcagagtatgatgaccctcccaggcctgagggagaaggcagagtatcttctgagggaatgggtgaatctctaccatttcagcagcagctggccgcgacagtaccaaagctttctctgcatttgttgacagatgcaccaccagggaatactgacaccgatgatctcataccaaggt

SEQ ID NO: 1140 - DNA, 292 bp, Homo sapiens
tgatttgaataatggagctgggaatatggctggatatctggtactaaaaaagggtctttaagaacctacttcctaatctcttccccaatccaaaccatagctgtctgtccagtgctctcttcctgcctccagctctgccccaggctcctcctagactctgtccctgggctagggcaggggaggagggagagcagggttgggggagaggctgaggagagtgtgacatgtggggagaggaccagctgggtgcttgggcattgacagaatgatggttgttttgtatcatttgatt

SEQ ID NO: 1141 - DNA, 267 bp, Homo sapiens
ctgtgttggcgcagtgtggtccactctcaatcactctcagttctttgataaatttggggtggaaaggtttggagtatgtctttatgcactgacatctaagttctttagcactccttggcaaaactgcaccttcacacagagctgcagaaatcaggaaggctgccaagagagccacggccagcttggaagtcatgtttacacacagtgagatggttccttccggtggtttcttcctggctcttgtcctagaagcttgtgtgctcctcg

SEQ ID NO: 1142 - DNA, 130 bp, Homo sapiens
gaacaccgacaaacccagccctggcgctgagcctctctaccccaggtcagacggacagaaagacagatcacaggtacagggatgaggacaccggctctgaccaggagtttggggagcttcaggacattgc

SEQ ID NO: 1143 - DNA, 193 bp, Homo sapiens
acattccgccttccttccatgtagtccctcttggtaatctaccaccaagcttgtggacttcactccaacaaaattgtaagcgttgttaggtttttgtgtaagattcttgctgtagcgtggatagctgtgattggtgagtcaaccgtctgtggctaccagttacactgagattgtaacagcatttttactttct

SEQ ID NO: 1144 - DNA, 228 bp, Homo sapiens
acatgctgggcatacggaaagtactgagcccatatgacttgacccacaaggggaaatactggggcaagttctacatgcccaaacgtgtgtagtgagtgtaggagataactgtatataggctactgaaagaaggattctgcatttctattcccctcagcctacccactgaagtctttgggtagctcttaagccataactaaggagcagcatttgagtagatttctgaaa

SEQ ID NO: 1145 - DNA, 279 bp, Homo sapiens
tgaggaaggtgatggccaccccactcttgcctgctcgtcccgtgcggccaatgcggtggatgtaatcttcaatatttttggccatatcatagttgacaaccatagacacatcttggatgtcaataccacgaccagccacatctgtagccaccaaaatatccttggccccagccttgaggttggacaacgcaaactctcgctgctcctggccttttccaccgtgcagtgtgcaagcattgtaccccatcttctccagggatttggccaacacgtcgcagc

SEQ ID NO: 1146 - DNA, 254 bp, Homo sapiens
tagagaaaggccagcgtttcaccctgcgagatggcaaccggactattggcaccggtctagtcaccaacacgctggccatgactgaggaggagaagaatatcaaatggggttgagtgtgcagatctctgctcagcttcccttgcgtttaaggcctgccctagccagggctccctcctgcttccagtaccctctcatggcataggctgcaacccagcagagggcagctagatggacatttcccctgctcggaaggg

SEQ ID NO: 1147 - DNA, 260 bp, Homo sapiens
aggagccttaggatgcagcatgccttcaggagacactgctggacctcagcattcccttgatatcagtccccttcactgcagagccttgcctttcccctctgcctgtttccttttcctctcccaaccctctggttggtgattcaacttgggctccaagacttgggtaagctctgggccttcacagaatgatggcaccttcctaaaccctcatgggtggtgtctgagaggcgtgaagggcctggagccactctgctagaaga

SEQ ID NO: 1148 - DNA, 212 bp, Homo sapiens
gacatcactgatgatacggcatgataaggtacttagaagttttgattcaatgatcagcaccaactgcacggaggagctggagaacgctggcgtggaggtgctgaagttctcccaggtcaaggaggttaaaaagactttgtcgggcttggaagtcagcatggttactgcagttcccggtaggctaccagtcatgaccatgattccagatgttg

SEQ ID NO: 1149 - DNA, 265 bp, Homo sapiens
agtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccct

SEQ ID NO: 1150 - DNA, 219 bp, Homo sapiens
caaaataaatatctcctccccgctttggggagttgggggggtctgtatcttagggccagccctcctagtgggccagccccctagtgttaaaaataggtccctaaccccccagggtgacccccgtggtggaatttcaggacatctgagtgagtggggcctagtgtcaagtctgccccccaagtcagcctggcccccagggcctctaggaaggcctcgtgc

SEQ ID NO: 1151 - DNA, 32 bp, Homo sapiens
caccaaagttctgaggcattaagccagcagaa

SEQ ID NO: 1152 - DNA, 163 bp, Homo sapiens
agctgccctagctgaccccgagaagtgctcttggctgacccctctggtgtgtggtgaggggctttctcttccccttcctgtttcagacccccccatttcccgcacatggtgtggggggctgggggaggtccaagcagagtgttttattattatcgctttatgt

SEQ ID NO: 1153 - DNA, 146 bp, Homo sapiens
tatatttgatatacttctgcctaacaacatggaaaagggttttcttttccctgcaagctacatcctactgctttgaacttccaagtatgtctagtcaccttttaaaatgtaaacattttcagaaaaatgaggattgccttccttgt

SEQ ID NO: 1154 - DNA, 252 bp, Homo sapiens
gtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttt

SEQ ID NO: 1155 - DNA, 240 bp, Homo sapiens
aaacttgtaggagagcgatactgcaagaccacagatgtgcttaccatcaaaacagataggtgccctttaaggaggcagaattacgattatgcagtgtatctactaacagtgttataccatgagtcttggaatactgaagaatgggaaaaaagtaagactgaagcagacatggaagagtatatatgggaaaatagctcatcagaaagaaatatcctggaaacgctctccagatgaaagctg

SEQ ID NO: 1156 - DNA, 268 bp, Homo sapiens
ttttcagtttgcttggaggtagctgggtaatcaaaaatgtttagtcattgattcaatgtgaacgattacggtctttatgaccaagagtcttaaaatctttttgttatgctgtttagtattcgtttgatattgttacttttcacctgttgagcccaaattcaggattggttcagtggcagcaatgaagttgccatttaaatttgttcatagcctacatcaccaaggtctctgtgtcaaacctgtggccactctatatgcactttgttta

SEQ ID NO: 1157 - DNA, 219 bp, Homo sapiens
gcatttgtgattatatgtgtactcattctcttacctagcgaacaagatcttttcaaagtggtgtttctaaaagagcatgtacaaaagtggcctgtggacatttaggcctgggtgatgcatttgctcttcctgtttgtgccaatgtatcaatgtaaagttgctctgttttcttcaactgtatttattgctgcatttctcagcataaacttatcccattgt

SEQ ID NO: 1158 - DNA, 249 bp, Homo sapiens
gatagattttctaaccaagcagatggagaaaatccaaccagctcttcaggagaagcacgccatgaaacaggccgtcatggaaatgatgagtcagaagattcagcagctcacagccctgggggcagctcaggctactgctaaggcctgagagtttttgcagaaatggggcagagggacaccctttgggcgtggcttcctggtgatgggaagggtcttgtgttttaatgccaataaatgtgccagctgggc

SEQ ID NO: 1159 - DNA, 286 bp, Homo sapiens
tattctgaatctcatcctgcaggcggccaatagtgtcttggtagttagcagcttcaacggcaaagttctcttccatttcacgcatctggcgttccagggactcattggttcctttaagggcatccacttcacaggtgagggactgcacctgtctccggtactcagtggactcctgctttgcctggcgcagggcgtcattgttccggttggcagcctcagagagtcagcaaacttggatttcctcttcgtggagtttcttcaaaaggcaatctcttcttgcaaagat

SEQ ID NO: 1160 - DNA, 280 bp, Homo sapiens
ataaagcttacatagttttcttcctttgaaagactgtgctgtcctttaacataggtttttaaagactaggatattgaatgtgaaacatccgttttcattgttcacttctaaaccaaaaattatgtgttgccaaaaccaaacccaggttcatgaatatggtgtctattatagtgaaacatgtactttgagcttattgtttttattctgtattaaatattttcagggttttaaacactaatcacaaactgaatgacttgacttcaaaagcaacaaccttaaa

SEQ ID NO: 1161 - DNA, 280 bp, Homo sapiens
ttcctaagccaagagtcatgtcaaattgcaatcaggctcaaaaccagagaccaggctgtgaaatccacacatctttagaactagtcgtctcctcttggcctcagcagctcttccctgttcttactggttgacattttgatcactctttgcacactcttgtgttttttgctcactgtcacactcccagcacctagtatgctcagtaaatgtttgtggaataagtgcataaaatgttcttaacctttgattctacttacagcccatgatagcctcttagata

SEQ ID NO: 1162 - DNA, 203 bp, Homo sapiens
ccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataa

SEQ ID NO: 1163 - DNA, 195 bp, Homo sapiens
agtctgctgagactcttgacagcacctccagctctgctgcttcaacaacagtgacttgctctccaatggtatccagtgattcgttgaagaggaggtgctctgtagcagaaactgagctccgggtggctggttctcagtggttgtctcatgtctctttttctgtcttaggtggtttcattaaatgcagcacttggt

SEQ ID NO: 1164 - DNA, 250 bp, Homo sapiens
aaatggctggtcgtacatatggaacaggtgctccatttgacacgtgagcaaagctgacaacagcatctagctgagctaacacatcattgagtgtctgcattggttctacatagcctgaagaaatattgacaatttctttaacaatggcatcctgggcttcttcatattctgttttatttttggtatactcttcatttaaagaagtcaatttgctgttggtaaatttaacaccattcttctggatatctac

SEQ ID NO: 1165 - DNA, 226 bp, Homo sapiens
gaaacagactcgattcatattgaatataatatatttgtgtatttaacagggaggggaagagggggcgatcgcggcggagctggccccgccgcctggtactcaagcccgcggggacattgggaaggggacccccgccccctgccctcccctctctgcaccgtactgtggaaaagaaacacgcacttagtctctaaagagtttattttaagacgtgtttgtgtttgtg

SEQ ID NO: 1166 - DNA, 265 bp, Homo sapiens
ttctaaatgagctcgagatccacatgctatagccatttgattaggccaaggctgtagatcatttagccccttttctaatttctcaacatctggaaactttgtggctccatcagcatctgccataaggatcttttctcctcgagaactgaatatacccattctaatcgctccacctttttcacgattcttcaccagggttatcacacgtactttgtcactttcatatttctggcaatttttaaaagctacctttgaggtctgatct

SEQ ID NO: 1167 - DNA, 71 bp, Homo sapiens
gggactgatgtcatcttgagctcttcatttattttgactgtgatttatttggagtggaggcattgttttta

SEQ ID NO: 1168 - DNA, 236 bp, Homo sapiens
actcatcaattaacttctacagtggagactacttctgggactggaatataaaaaagaatcaaaggttctgattttgagttgcaataaagggaaagaccatgctcatagcagtgccaacatctgaagtgtggagccttacccatttcatcacctacaacggaagtagttaactggaagagattaccaagagaataaaaagagactcattcagtggaaccaacctcgtgcagcccggg

SEQ ID NO: 1169 - DNA, 216 bp, Homo sapiens
ttttgttaagagtgcagtattgcagagtctagaggaatttttgtttccttgattaacatgattttcctggttgttacatccagggcatggcagtggcctcagccttaaacttttgttcctactcccaccctcagcgaactgggcagcacggggagggtttggctacccctgcccatccctgagccaggtaccaccattgtaaggaaacactttcag

SEQ ID NO: 1170 - DNA, 32 bp, Homo sapiens
acaggacagcaggacggtttgttttcagtgga

SEQ ID NO: 1171 - DNA, 277 bp, Homo sapiens
aaattcatcatttaggacaccctcagcccatcctcatgggttctgtagccgttggatctggactgtcctggcatcgaactctccctctgtgtgtaattggaggagaccacaagctgttgttttgggtgactgaagtataaagtgttttctgtaccttagattcacaaactttgtatttttagtacatattttgaagaatttctatagtacatattttgaagaatttttatatcaaatataccgtatactttagaaaatgtctcagttgcttttatta

SEQ ID NO: 1172 - DNA, 220 bp, Homo sapiens
ttgggtttgaaattcctgatatagatgctgaaaagttaatgtgtccacaagaaattgtagattacattgcagataagaaggatgtatatgaataaagtatcagaccctttggctttgctgagagaggactcagatgatagtgacgaatgtctggcagtgaggacacattttggcattcttgctgactctgacagagtgattctgatggacttgtatttaa

SEQ ID NO: 1173 - DNA, 246 bp, Homo sapiens
ttctatttgtgcaaactctgtaaatatgtgtttaaacaaatgtaatattttgtacaagatacactggagaacaaagggaactcaagattcttccagccacatgtcacctgtaggtagaagtaaactctgcagtgcagcttctgctcttggcccctctggccagggcccctgtggcttcctgcacactggacaggtgactgtatggtagagactgtgatctgggaactttttgctgtacaaatctgt

SEQ ID NO: 1174 - DNA, 278 bp, Homo sapiens
gaccagctcaggacccaggtggtgaggctacaagcagagaaggcagacctgttgggcatcgtgtctgaactgcagctcaagctgaactccagcggctcctcagaagattcctttgttgaaattaggatggctgaaggagaagcagaagggtcagtaaaagaaatcaagcatagtcctggggcccacgagaacagtctccactggcacggcattgtctaaatataggagcagatctgcagatggggcccagaattacttcgaacatgaggagttaactg

SEQ ID NO: 1175 - DNA, 200 bp, Homo sapiens
ggtaaggctggtgatcttcaagccagtccgatagctcagggtcctgttggtcttctctgagtgggtacagcttttctccaccagctccagctcttctccttcttcccacaagcgcacgatcgtggtcctgcagaggtcctgtcccagggcgcactcttccacacggcaatccccgttggtcttacactgcatgcaccgca

SEQ ID NO: 1176 - DNA, 200 bp, Homo sapiens
ggcattgcctagctggaacaagaaggcagtgctatctatagcagctgcggcttaagtgcacataacagatacttttattaattctgataacctcctgaatggtggaaagaagtttccaaacagttcccttgaacatttacaaaatacacaactccgggacagcagtatctttaacaatgtcatgttctgaaaactctgat

SEQ ID NO: 1177 - DNA, 289 bp, Homo sapiens
  misc_feature (141)..(166): n is a, c, g, or t
ccagatttgctattggattaaaggaaactacctggattgtagggaggggtgacacagtgttccctcctggcagcaattaagggtcttcatgttcttattttaggagaggccaaattgttttttgtcattggcgtgcacacnnnnnnnnnnnnnnnnnnnnnnnnnnaaggtgtcttataatcttttacctatttcttacaattgcaagatgactggctttactatttgaaaactggtttgtgtatcatatcatatatcattttagcagtttgaaggcatacttttgcat

SEQ ID NO: 1178 - DNA, 212 bp, Homo sapiens
agagaacagagggtccagggccctcctggctcccaacagcttctcagttcccacttcctgctgagctcttctggactcatgatcgcagatccggggcacaaagagggtggggaacatgggggctatgctggggaaagcagccatgctcccccgacctccagccgagcatccttcatgagcctgcagaactgctttcctatgtttacccaggg

SEQ ID NO: 1179 - DNA, 240 bp, Homo sapiens
gggaatctcactgacgaggcagagtcgttcactgtagtctggctgcagactctcagccagtcccttagacacaccactccaggccgaaaagttcccgtggtattcagtaacaagatcctctaagttcttcagggtgggaattcggggcatcgtccgttccagccagaaatacacacagagaaggctgataatcaatcccatggagccaacagagataaccacggcttccaatgcaaacag

SEQ ID NO: 1180 - DNA, 268 bp, Homo sapiens
aagtcacgtcctccgtgcgaccggattcctggtgcgccctggccctggcctgagcccacgccgccaggaggcagggagggctccgccgcgggcctcactccactcgtgtctgcttttgtgcagcagtccagacagtggcgactgcgctgacagaacgtgattctcgtgcctttattttgaaagagatgtttttcccaagaggcttgctgaaagagtgagagaagatggaagggaagggccagtgcaactgggcgcttgggccactcca

SEQ ID NO: 1181 - DNA, 239 bp, Homo sapiens
gaaagacagcctcccgctgctcggtcccccaggccccgccgtccttgctgttgcacacgatggtgttggcgtcgccgtgggcgttgaagcgagggttgaagtgcaggcacaggttgttgctgtctttgcccaggttcagcacgaagctcttagcgtcaggagccacctcgcctcgcactcgaaggcactctccaggtttgagattcaggttgctggcgaccagaccacaagccatgatt

SEQ ID NO: 1182 - DNA, 260 bp, Homo sapiens
tataatgtgctttctccatatagacatatttacacttgagtctttggcttatgttattttctaaaaagaactttaaatgatccagccatcattgcacattaaaagaaaataagccagttatatatatttatatattcccatagagatctgctacactggaaacatataaaaaacgaactttactatgaatttgcacagcttttcttttcttcttccttttaagattcatcagctttcattttagaaagggagcctcgtgc

SEQ ID NO: 1183 - DNA, 231 bp, Homo sapiens
gatcttttgccttgcaaattgctgcctgggtgaatgctgcttgttctctcacccctaaccctagtagttcctccactaactttctcactaagtgagaatgagaactgctgtgatagggagagtgaaggagggatatgtggtagagcacttgatttcagttgaatgcctgctggtagcttttccattctgtggagctgccgttcctaataattccaggtttggtagcgtgga

SEQ ID NO: 1184 - DNA, 285 bp, Homo sapiens
cacattttggattcctccatcagcaatgaccggaacaccaaagcgccgtgcatactctgacaccttgtacactgctgttgcttggggccgcccacaggccagcacttcctgcgtaatgcagatggagcccacttcccatgcccacccgcagggcatccacacctgcatcaatgaggttcttggcctgggcagcagtgaccacattgcctccaatgacttggagattagggtatttgtctttgatgtacttgatcatattgatctggaagatggaatttccctggg

SEQ ID NO: 1185 - DNA, 117 bp, Homo sapiens
agggttagttggtattctcatggcctgattttttttgtttctattccttttatatcactgtgtttgaatcgagggggaggggtggtaaccggaaataaagatctccgatcttccgcc

SEQ ID NO: 1186 - DNA, 284 bp, Homo sapiens
  misc_feature (213)..(213): n is a, c, g, or t
atagtgttgggcactgtctgaccatgttgcatttggaaggctaaatggggccatgaagaaggctggaagggacaggtggtgatggcagcctacctggtgtcccctaccccacctgttctcggagaaccaagttgctacacaggaagttctccaaggtccagtttcctttctcccaccagttggtggaggcttcagggaagaccagagtcctgnacagagagggtaacaggaggagtcggggataaacatcaaacatcaatcgtgtgtcctgatttgggagtgat

SEQ ID NO: 1187 - DNA, 294 bp, Homo sapiens
ctgcctccgttatgagatcaaggatatccatgtgccaccccgggtgaaagagtctatgcagatgcaggtggaggcagagcggcggaaacgggccacagttctagagtctgaggggacccgagagtcggccatcaatgtggcagaaggaagaaacaggcccagatcctggcctccgaagcagaaaaggctgaacagataaatcagcagctgagaggccagtgcagttctggcgaaagccaaagctaaagctgaagctattcgaatcctggctgcagctctgacacaacataatgg

SEQ ID NO: 1188 - DNA, 283 bp, Homo sapiens
gaggcctcaaagtaggccacgtggtgggaggcgccgaaggcagaggcttctgatcgggggacctggcgctgtgactccagatctgccttgttcccgaccaacacaacggggaagtcgtcgcggtccttgacccgcagaatctgcgtgaagagcttgcccacctcgttgaaactctgccggtcattaatggcgaacaccagcaggaaaccgtggccagcacgcatgtactgctctctcatggccccgaactcttcctggcccgcggtgtccagggatgtccagc

SEQ ID NO: 1189 - DNA, 261 bp, Homo sapiens
gctgcaaaaaaggtgctgaggcttgaagagcgagaagtgctgaagtctaaagagcttgggggtagccactaattaactactgtgtcttctgtgtcacaaacagcactccaggccagctcaagaagcaaagcaggccaatagaaatgcaatatttttaatttattctactgaaatggtttaaatgatgccttgtatttattgaaagcttaaatgggtgggtgtttctgcacataccttctgcagtacctcaccagggagcat

SEQ ID NO: 1190 - DNA, 252 bp, Homo sapiens
agctgccatcatgatgatgcggtgtgccagattcgtcccccgcttctgcgccgaccaccccttccttttcttcatccagcacagcaagaccaacgggattctcttctgcggccgcttttcctctccgtgaggacagggcagtcttggtgtgcagcccctctcctctctgtcccctgacactccacagtgtgcctgcaacccaagtggccttatccgtgcagtggtggcagttcagaaataaagggcccattt

SEQ ID NO: 1191 - DNA, 141 bp, Homo sapiens
agagtacctagttcatcagccgtccagtaaagcaacccaaggaaactgactgggtctctttgcctaccgtattaacattaaacattgatgtttctgtattctgtactttactgcaccccagcagactttcaacaactcatt

SEQ ID NO: 1192 - DNA, 34 bp, Homo sapiens
tcactgggtggggtgaggaccactccttacactg

SEQ ID NO: 1193 - DNA, 273 bp, Homo sapiens
taagtgtgagtaagagctggtgtctgattgttaagtctaaatatttccttaaactgtgtggactgtgatgccacacagagtggtctttctggagaggttataggtcactcctggggcctcttgggtcccccacgtgacagtgcctgggaatgtattattctgcagcatgacctgtgaccagcactgtctcagtttcactttcacatagatgtccctttcttggccagttatcccttccttttagcctagttcatccaatcctcactgggtggg

SEQ ID NO: 1194 - DNA, 158 bp, Homo sapiens
gggaatcctggtgctcaaattaccctccaaaagcaagtagccaaagccgttgccaaaccccacccataaatcaatgggccctttatttatgacgactttatttattctaatatgattttatagtatttatatatattgggtcgtctgcttcccttgta

SEQ ID NO: 1195 - DNA, 260 bp, Homo sapiens
atgtttcatgccacagtggcaactgagaatgaagtcttccgagtgaaggtttttaatattgacctaaaggagaagttcaccccaaagaagatcattgccatagcaaattatgtttgccgcaatgggttcctggaggtatatcctttcacacttgtggctgatgtgaatgctgaccgaaacatggagatcccaaaaggattgattagaagtgccagcgtaactcctaaaatcaatcagctttgctcacaaactaaaggaag

SEQ ID NO: 1196 - DNA, 163 bp, Homo sapiens
gaatgacccccttatatattttctgaaaatgaaaacagttacatgaaaaaaatttccaatgaagatgtcagcattttatgaaaaaccagaagttattagatgaaagcagcgagtgaatctttaaacagacttgatcacgcacacacaataagtctttctctcc

SEQ ID NO: 1197 - DNA, 251 bp, Homo sapiens
gaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaatgcaaagcatttcttcctgattaaattgtagatgtagactttac

SEQ ID NO: 1198 - DNA, 265 bp, Homo sapiens
tcccatactgttttcagccttttgtttataattagaaattgtgagaagcttcatttagtgtttaaaaatgtggggagataaatcagacttaacatgtatgtaagatcaattcacttaaaagtatggtccaaatagcaaaaataggaccaggtgaaacatgtagtcattttttaaaaacatgtacttggtcttttgtgtgtgtctgttttattccattagaataaatgtgtccttgatgtaatgcaaagcatttcttcctgattaa

SEQ ID NO: 1199 - DNA, 251 bp, Homo sapiens
gcaaagcaagacctgaagcccactccggaaactaaagtgaggctcgctaaccctctagattgcctcacagttgtttgtttacaaagtaaactttacatccaggggatgaagagcacccaccagcagaagactttgcagaacctttaattggatgtgttaagtgtttttaatgagtgtatgaaatgtagaaagatgtacaagaaataaattaggagagattactttgtattgtactgccattcctactgtat

SEQ ID NO: 1200 - DNA, 206 bp, Homo sapiens
ttgttttatcagtgctaatgtgtgcaagcagtttttttattttgcttttctcctggcatcagaaagtggtggcgttttctgtactggattgcaccaaggaagcttttggggaggaaggaaggacattaaattctttccctggtaatgaaaagagccctttatcaatacagtgctgcaatttctggatatcagctacactttgtttt

SEQ ID NO: 1201 - DNA, 80 bp, Homo sapiens
gtggagctgacctcgcttaagggcagggagaagctggcacctgtacccttcttctctctcctgcagtatgagtgaccaca

SEQ ID NO: 1202 - DNA, 71 bp, Homo sapiens
atcctcagtgaagtgcattcggaatgaggatggaacttggttaacaccaaatgaatttgaagtcgaaggaa

SEQ ID NO: 1203 - DNA, 114 bp, Homo sapiens
atatacgttgtgaaaggacgaccctaggagagctgctgaagagtggacctttgctctgtcctccaagaataaatctccagagagagtttaaatagcaagtgaatttctactacc

SEQ ID NO: 1204 - DNA, 276 bp, Homo sapiens
agggtggcacagatcgcagcaccttgaggggctgcgggtctgagggaggagacactcagctcctccctctgagaagtctcaagctgagaggagagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttccctgcgagaaa

SEQ ID NO: 1205 - DNA, 228 bp, Homo sapiens
atggcaacagccacacagtcattgccttcaacacagagccacgtgtccccaaacagcaatagtcatgcccttgtccaggctgggatctaattgatacaataggtcgttgactccctcctagtagagctatctaggtttgtctggaaagtttccgaccctggcttataggcaccacacctcatgtactcctcatggcttggatctctgtattcagcctttgttcagtcc

SEQ ID NO: 1206 - DNA, 183 bp, Homo sapiens
ataaggtattttctccctagcttctcatttacagtatttctaattgcttcacactttacagttttaatacaaagtacaagctctacttttataacgtgtactacaagtttctttaaaagaatgttgtattttcagctgacctcttgtatcttgcattctttgttattttctgcaggctacccc

SEQ ID NO: 1207 - DNA, 233 bp, Homo sapiens
tacctaatatctgagtgtatgccattcggtatttttagaggtgctccaaagtcattaggaacaacctagctcacgtactcaattattcaaacaggacttattgggatacagcagtgaattaagctattaaaataagataatgattgcttttataccttcagtagagaaaagtctttgcatataaagtaatgtttaaaaaacatgtattgaacacgacattgtatgaagcacaa

SEQ ID NO: 1208 - DNA, 79 bp, Homo sapiens
gaggactcttcgagacattgagaccttctacaacacctccattgaggaaatgcccctcaatgttgctgacctcatctga

SEQ ID NO: 1209 - DNA, 207 bp, Homo sapiens
aggaatgacctctagggcctgggcaacagccctgtatggccattgttccacaccagtcatggccttggatttttctgtcaaggcatgggccacagccatctcggaggccccaccccctggcaccagctgagggtccaggaaacattgcgacacacttgcatggcatcctgaaggttgcgttctacttccgagaaaatctctttgcta

SEQ ID NO: 1210 - DNA, 264 bp, Homo sapiens
ccacgtcggccttggagagtttgatgagactagatatgtgttcaatctgtactctggaaaaaggctcaatgactcggatcagattctgttctagtaagttatcatacaacttggccaagtgtgtgctgatgattgggtcatcccggagctctgcccggtaatctgtcagagccttttcaaaatctgccagtgatctgttcttgctagccctgagctcacgcattttaatgctttctgtctgcctccctgcataccgaatgcaag

SEQ ID NO: 1211 - DNA, 283 bp, Homo sapiens
cccttcaattatagttagtcttggtgaagtaagatgtttgtagactttagagttctttaattcttggcacaacgtgactgttgagctaacaccaaatagtgtgttggcaatacttttcaaatggctgaaaacacctaaaaattgttcattccgaaatatctgtcactgctctgttgccaaactcagaatagaacttagacgtatgtctgagtccctgagatcacatgctaaagtcgatgaaagtaaccactgccactgtctgtgtcagaactttacagtacag

SEQ ID NO: 1212 - DNA, 274 bp, Homo sapiens
aagatctgaaatgcgtgctgatgacaagtttgttaatgtaacaatagtaacaattttggcagaaaccacaagtgacaatgagaagactgtgactgagaaaattaataaagcaattagaagtagctcaagcaactttctaaactatgatttgacccttcggtgtgattattatggctgtaaccagactgcggatgactgcctcaatggtttagcatgcgattgcaaatctgacctgcaaaggcctaacccacagagccctttctgcgttgcttcc

SEQ ID NO: 1213 - DNA, 263 bp, Homo sapiens
aatgggttctgggcctgccttcccaggtaaccaaaaccattattcaaaagcaactactgaaatgccagcttgtggggaaagaaatgggaaaggtgataaaatcacaattaaatgcatgtatatacatgaataccaaagctattatgtagaaataaaatcaaaacactttagaccaagaagaaatcagagacctcctagtctattgcccccagtgtaaaaattaaaaaactctggagtaatcattgccattaagcattagtatg

SEQ ID NO: 1214 - DNA, 268 bp, Homo sapiens
aaggaaatgggttctgggcctgccttcccaggtaaccaaaaccattattcaaaagcaactactgaaatgccagcttgtggggaaagaaatgggaaaggtgataaaatcacaattaaatgcatgtatatacatgaataccaaagctattatgtagaaataaaatcaaaacactttagaccaagaagaaatcagagacctcctagtctattgcccccagtgtaaaaattaaaaaactctggagtaatcattgccattaagcattagtatg

SEQ ID NO: 1215 - DNA, 242 bp, Homo sapiens
ccttcgccctctagggagcagacctccactgccattgtcctgtgagccgccaaagaccccacggggtgcccgcatgtccctgtctagggcagcccagggcccccactcctggctcctcacacttgcctcccctatggccgctctccagaccctcctcctttcttctccccacatccgcacctgctgttcccactctggggttctcaagtccatgaacagatattgttgcattttccacaatg

SEQ ID NO: 1216 - DNA, 41 bp, Homo sapiens
gtgacttgagttcccttaagtcctctggggctggtgacctc

SEQ ID NO: 1217 - DNA, 271 bp, Homo sapiens
acggaagcgctgaaagactaggatgtgatttattaacgaccaacttctgttattgtgtgttaagtttttcatctgtgcatcaaatcacaaaaagaataaatagagctttttctttatcagtcccttgggcacagaaggtcctgaacaccctgctctacaatgttgcatcagagttcaaacaacaaataaaaaatattaagagggaaatccccatcctgtgacttgagttcccttaagtcctctggggctggtgacctctttttgctaatag

SEQ ID NO: 1218 - DNA, 293 bp, Homo sapiens
atgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaccacatgctgctgaatttaccagggatcctcatacctcacaatgcaaaccacttactaccag

SEQ ID NO: 1219 - DNA, 262 bp, Homo sapiens
aaagtgcccctgcaggccgggttctgccgccaggactgcccccttcccagagccctgtacatcccagactgggcccagggtctcccatagacagcctgggggcaagttagcactttattcccgcagcagttcctgaatggggtggcctggccccttctctgcttaaagaatgccctttatgatgcactgattccatcccaggaacccaacagagctcaggacagcccacagggaggtggtggacggactgtaattgatagat

SEQ ID NO: 1220 - DNA, 192 bp, Homo sapiens
taaaacagaatttggtagcacttacctctacagacacctgctaataaattattttctgtcaaaagaaaaacacagcatgtgtgagagacagtttggaaaaatcatggtcaacattcccattttcatagatcacaatgtaaatcactataatacaaattggtgttaaatcctttgggttatccactgccttaa

SEQ ID NO: 1221 - DNA, 192 bp, Homo sapiens
gtatgtgaccaaagtccttaagggaaagaagttaagtcttccaatgccaatctgaggaccttcagagacagtctacgccttaacaagcacatgaaggaaactattttgaatgttctctttggcaacttatccataatttgggatcaaatgttaaaaccagaaaagtgtttagtgtggatttcagcaaacctg

SEQ ID NO: 1222 - DNA, 291 bp, Homo sapiens
gatgttcgcaggaaaaatctggagatttacgaggctgtgacgtccccccagggccccgccatgacctggagcatgtttgctgtgggctggatggagctgaaggacgcagtgcgggcccggggcctcctggacaggagctttgccaacatggctgaacccttcaaggtgtggacggagaatgcagacgggtcagcgctgtgaacttcctgacaggcatggggggcttcctgcaggcggtggtcttcgggtgcacgggggttcagggtcacccgagcgggtgtgacctttgac

SEQ ID NO: 1223 - DNA, 269 bp, Homo sapiens
gttggcattccggtggctctccatgtccacctccccttgttctgcattttctttgaagcatagcttctttttctggtaagcaatgaagctagagatggctccagccacggcgaccacgacagcccccacaatcccggggatcacgcctggggcgtcggcctcttccccttctttcctgtggctgcctccaccatcactgcctccttttccttctccacctgaaacgccatccgcaaggtcagcatctgaaaagctaccggaggaactag

SEQ ID NO: 1224 - DNA, 265 bp, Homo sapiens
ttggcattccggtggctctccatgtccacctccccttgttctgcattttctttgaagcatagcttctttttctggtaagcaatgaagctagagatggctccagccacggcgaccacgacagcccccacaatcccggggatcacgcctggggcgtcggcctcttccccttctttcctgtggctgcctccaccatcactgcctccttttccttctccacctgaaacgccatccgcaaggtcagcatctgaaaagctaccggaggaac

SEQ ID NO: 1225 - DNA, 195 bp, Homo sapiens
atcacaccgcagcagggccaggcactggccaagcagatccacgctgtgcgctacctcgaatgctcagccctgcaacaggatggtgtcaaggaagtgttcgccgaggctgtccgggctgtgctcaaccccacgccgatcaagcgtgggcggtcctgcatccttcttgtgaccctggcacttggcttggaggctgcc

SEQ ID NO: 1226 - DNA, 34 bp, Homo sapiens
tgcaaactgcagagtggcactcattgcttgtgga

SEQ ID NO: 1227 - DNA, 157 bp, Homo sapiens
  misc_feature (117)..(127): n is a, c, g, or t
agaaaaatttgaagtctgatcagagatttacaactgttcattatagtggtgccttaggcaatctttccaaagtaaattcagggccccattgctacttatgccatatttggacatacnnnnnnnnnnncttcaattttgtaaacttcctggaaagctg

SEQ ID NO: 1228 - DNA, 269 bp, Homo sapiens
ttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttata

SEQ ID NO: 1229 - DNA, 263 bp, Homo sapiens
ttttatcacagtattctcagggtgaaattaaaccaactataggcctttttcttgggatgattttctagtcttaaggtttggggacattataaacttgagtacatttgttgtacacagttgatattccaaattgtatggatgggagggagaggtgtcttaagctgtaggcttttctttgtactgcatttatagagatttagctttaatattttttagagatgtaaaacattctgctttcttagtcttacctagtctgaaacatt

SEQ ID NO: 1230 - DNA, 172 bp, Homo sapiens
tggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccatt

SEQ ID NO: 1231 - DNA, 234 bp, Homo sapiens
tggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtc

SEQ ID NO: 1232 - DNA, 260 bp, Homo sapiens
  misc_feature (186)..(218): n is a, c, g, or t
atcaaatgcaaaactcccaaattataaaacagtcaggctacactcaaaacaaaacatagaacatcaacaacacacatctcccaaaaaagaagtgcaacgcatgcttgtataaaccaacaataacaaaaaaaccacaataaaaaatgcagagtctcccaaacaagttttcaaatgtattgcagaagnnnnnnnnnnnnnnnnnnnnnnnnnnnnnnnnngtctgaaatactagtgcatagtcaattacctaacaccaagtt

SEQ ID NO: 1233 - DNA, 278 bp, Homo sapiens
gttcagggcttctctggagcagatattgtcaagttcatggccttaggtagcatgtatctggtcttaactctgattgtagcaaaagttctgagaggagctgagccctgttgtggcccattaaagaacagggtcctcagccctgcccgcttcctgtccactgcccctccccatccccagcccagccgagggaatcccgtgggttgcttacctacctataagtggtttataagctgctgtcctggccactgcattcaattccaatgtgtacttcatagtgt

SEQ ID NO: 1234 - DNA, 78 bp, Homo sapiens
actgccccacgttgtccctgagatttaacccctccactgctgggggtgagctgtactcttctgactgccccctcctgt

SEQ ID NO: 1235 - DNA, 253 bp, Homo sapiens
ggccctgctttctacgccaatgttatgccagctccatgttctcccaaataccgttgatgtgaattattttaaaggcaaaactgtgctctttattttaaaaaacactgataatcacactgcggtaggtcattcttttgccacatccctatagaccactgggtttggcaaaactcaggcagaagtggagacctttctagacatcattgtcagccttgctacttgaaggtacaccccatagggtcggaggtgctgt

SEQ ID NO: 1236 - DNA, 199 bp, Homo sapiens
cttttctccatttctagcatatggacacctggcctctgcttgagcacttaggtgacaggaacttccgcacctcctgaggccctggatgattctaattgttagaaattctaattgttagaaatccttccttataatgaatgaattctgctttcctataatttctacctattgggccttgttctgttctctggaactaaac

SEQ ID NO: 1237 - DNA, 67 bp, Homo sapiens
cgaccttcatccactattcttatgataatgctggcgggcagagatgatcaatctcctattaaatcat

SEQ ID NO: 1238 - DNA, 138 bp, Homo sapiens
caggagccagagttgatgagcagatctgtggaagaacaatccagggctgagaaatcgtagagcagtgaggcaggctgggagcatggaggacagcttatggaaaaagttagggcgtggggccacatgtgtgaattttac

SEQ ID NO: 1239 - DNA, 175 bp, Homo sapiens
aattcggcgttgaaattgggccagtttgttttgtgtaaagtaagccaagacacatcgacaatgagcaccaccatcaatgaccaccgccattcacaagaactttgactgtttgaagttgatcctgagactcttgaagtaatggctgatcctgcatcagcattgtatatatggtctt

SEQ ID NO: 1240 - DNA, 219 bp, Homo sapiens
aaggtgaaacactgctgagtcctttggtgatgtgtggtccccatggcctcaagttcctgaagcctgtggagctgcgcttaccacactgtgcgtccatgactcctgacggtgatcctaaaacctggcaaaacaagtgtcttcccggagatccaaattatctcgttggagcaaactgtgtttctgtccttattgaccacttttaactcttgaaatatagga

SEQ ID NO: 1241 - DNA, 239 bp, Homo sapiens
cataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttg

SEQ ID NO: 1242 - DNA, 252 bp, Homo sapiens
  misc_feature (190)..(227): n is a, c, g, or t
accagggccagataaggaacagctcgggccactcttctgaaggccaacgtggaggaaagggagcagccagccatttgggagaagatctcaaggatccagactctcattcctttcctctggcccagtgaatttggtctctcccagctctgggggactccttccttgaaccctaataagaccccactggagnnnnnnnnnnnnnnnnnnnnnnnnnnnnnnnnnnnnnnaattgctgccaggattgtcactcca

SEQ ID NO: 1243 - DNA, 267 bp, Homo sapiens
ggagaagacacatcttcagcctagtccctgccaagcccaccaagagcaacagttagtccctagctcctccgtccccaccaagtacccacacatccatagccagagaggccacctgtctccaggacagaaaggaaactgggcatgttactcaaggggaaggaaaggggcctaaagcccagaccacagtcatagggcccagccctctagcttggaagggagagcccaggatcgggtgaaaatgggggcttgctccttaattgcgatccc

SEQ ID NO: 1244 - DNA, 91 bp, Homo sapiens
agagcaggagagacggcagagatatgttgctaggtgaatatatatttatataataaatccgtaagttaataaagtaaatagtaattctctg

SEQ ID NO: 1245 - DNA, 138 bp, Homo sapiens
accatcaaccaccaggcagccaggccatcagcccacctccacctctggagggtccccagagacccacgcccgacgcagacccggaggagcatcagcaaggggcccgggcagagaatcggctatgtcttcattatgaga

SEQ ID NO: 1246 - DNA, 298 bp, Homo sapiens
accaagttcctcatcgacaagaacggctgcgtggtgaagcgctacggacccatggaggagcccctggtgatagagaaggacctgccccactatttctagctccacaagtgtgtggccccgcccgagcccctgcccacgcccttggagccttccaccggcactcatgacggcctgcctgcaaacctgctggtggggcagacccgaaaatccagcgtgcaccccgccggaggaaggtcccatggcctgctgggcttggctcggcgcccccacccctggctaccttgtgggaataaacaga

SEQ ID NO: 1247 - DNA, 210 bp, Homo sapiens
atatcctgggatagtgcatgttcaccatctattttgtcagataatggggccttttaaaaaataatactttgctttcatgatatattgtatttttgtggaaagttaagtttagcaatatatactctaaaagcaaatttaattttttttaagccataaagaaattatactatatcccagtatctgtatgtctgtataaagcagtgtattatc

SEQ ID NO: 1248 - DNA, 260 bp, Homo sapiens
gtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaa

SEQ ID NO: 1249 - DNA, 275 bp, Homo sapiens
ggtgattgtaatttcaggtctgtcactcttgttacattgtgtacattcaaaaggaagagagaaaatatatatgataatcatttccacttaactaatttttacttctagcaggtaaatgtaggtagcagtgcaggggtgatctctgcttcctgtaccttgacatgcaaaaggctctcctaatactccacattcaaactgaagaggaaaattgaaatctctaatgaagctgctgtgtgtatttatgaatattaatgaataaaaactgcttggatggt

SEQ ID NO: 1250 - DNA, 100 bp, Homo sapiens
ggcaggaaagttgatgggattcattaggtttactggatggagcagttccctatataataccaatggaatagtaagggataaaacctacatgtgtattctt

SEQ ID NO: 1251 - DNA, 152 bp, Homo sapiens
gcaagttggcagtggttctggtactaaaaattgtggttgttttttctgtttacgtaacctgcttagtattgacactctctaccaagagggtcttcctaagaagagtgctgtcattatttcctcttatcaacaacttgtgacatgagattttt

SEQ ID NO: 1252 - DNA, 281 bp, Homo sapiens
ttctgagcactcaactcatgtttggcattttaaagtaaaaacaagtgtgacttcgaggaccaaagaaattgtcagctatacatttatctttatgaactcatttatattcctttttaatgactcgttgttctaacatttcctagaagtgttcttataaggtctaatgtatccacaggctgttgtcttattagtaaatgcaaagtaatgactttgtctgttttactctagtctttagtacttcaaattaccttttcatatccatgatcttgagtccatttggg

SEQ ID NO: 1253 - DNA, 147 bp, Homo sapiens
cagagctgagtgttgcccgccaccgccccgccctgccccctccagtcccccaccctgccgagaggactagtatggggtgggaggccccacccttctcccctaggcgctgttcttgctccaaagggctccgtggagagggactggcag

SEQ ID NO: 1254 - DNA, 218 bp, Homo sapiens
cagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatg

SEQ ID NO: 1255 - DNA, 270 bp, Homo sapiens
agtggtgtaattgtgattttcctgtgatactcccaagaaaactataaatagtgaaccccatgcaagtactgggaagcactagtcttttatcacaggttgaacctgaggaggtttaactcttgacattagtatctgtaaaagagcgtacggctctttttgctatgttttctccacaactgacatgcacttggtgtgggagaattccgatggctgtctgacctaagagtgatactactattcaaaatgtgggtaccttttcagtaatactga

SEQ ID NO: 1256 - DNA, 258 bp, Homo sapiens
ataatcgaaattatggaggttccttagtgctcaataatataagacctgttgttattagaacgagtctttcttataaactaacagagcaggtatatgcctgttagatcttagctgtggggttcctttactattgggtgaatcattaggtataaaaaataatcatcaaccaggccaaatactttgcttcctagctgatgtcatcccacattggtacagtgttattcattactgggtggttcaacagggaagccagtggga

SEQ ID NO: 1257 - DNA, 162 bp, Homo sapiens
ggttcctttactattgggtgaatcattaggtataaaaaataatcatcaaccaggccaaatactttgcttcctagctgatgtcatcccacattggtacagtgttattcattactgggtggttcaacagggaagccagtgggaccagtgtgtctgtcatgaaac

SEQ ID NO: 1258 - DNA, 250 bp, Homo sapiens
agaagaagatcacccacaacccatttggtcccggacagttctttgatctgtccattcgctgtggcttggatcgcttcaaggtttacgccaatggccagcacctctttgactttgcccatcgcctctcggccttccagagggtggacacattggaaatccagggtgatgtcaccttgtcctatgtccagatctaatctattcctggggccataactcatgggaaaacagaattatcccctaggactccttt

SEQ ID NO: 1259 - DNA, 145 bp, Homo sapiens
tactggaacctatgatctgaagagcgtcctgggtcaactgggcatcactaaggtcttcagcaatggggctgacctctctcggggtcacagaggaggcacctctgaagctctccaaggctgtgcataaggctgtgctgaccatcga

SEQ ID NO: 1260 - DNA, 175 bp, Homo sapiens
ttacactttatggtaagtagcagggggggaaatgcatttatagatcatttctaggcaaaattgtgaagctaatgaccaacctgtttctacctatatgcagtctctttattttactagaaatgggaatcatggcctcttgaagagaaaaaagtcaccattctgcatttagctgtat

SEQ ID NO: 1261 - DNA, 219 bp, Homo sapiens
tccagaaacgtcttcttaatccccaccttttcttactcccaaaaaagaatgaacacccctgactctggaatggtgtatactgccacatcagtgtttgagtcagtccccagaagagaggggaaccctcctccatcttttttgcaacatctcatttcttccttttgctgttgcttcccccctcacacacttggttttgttctatcctacatttgagatttc

SEQ ID NO: 1262 - DNA, 285 bp, Homo sapiens
tccagaaacgtcttcttaatccccaccttttcttactcccaaaaaagaatgaacacccctgactctggaatggtgtatactgccacatcagtgtttgagtcagtccccagaagagaggggaaccctcctccatcttttttgcaacatctcatttcttccttttgctgttgcttcccccctcacacacttggttttgttctatcctacatttgagatttctattttgtgttgaacttgctgctttttttcatattgaaaagatgacatcgccccaagagccaaaaa

SEQ ID NO: 1263 - DNA, 248 bp, Homo sapiens
acacagtctgtaagctttccccattgttcgtagtagttcctcaaactttcttctgtggtttcaaagcttaagccaccaataaagagcttacggaactgttccttttctctctccatcgcggactcagtcgcttcagcccgatttcccgcagccgagcgagatgagagagatctccgcggacgaacacgaaccggactcgtcctggcgctgtagtgagaactgccgctgctcgagaaacaactctgcga

SEQ ID NO: 1264 - DNA, 188 bp, Homo sapiens
ttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctt

SEQ ID NO: 1265 - DNA, 289 bp, Homo sapiens
aaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatcccaaacactgttttgttgcttgttttattatgacctcagattaaattgggaaatattggcccttttgaataattgcctcgtgc

SEQ ID NO: 1266 - DNA, 233 bp, Homo sapiens
gaccaaagcacccaagattcagcgtcttgttactccacgtgtcctgcagcacaaacggcggcgtattgctctgaagaagcagcgtaccaagaaaaataaagaagaggctgcagaatatgctaaacttttggccaagagaatgaaggaggctaaggagaagcgccaggaacaaattgcgaagagacgcagactttcctctctgcgagcttctacttctaagtctgaatccagtc

SEQ ID NO: 1267 - DNA, 51 bp, Homo sapiens
cataagccgcttatttatatcatgtatctctaaggacctaaaagcacttta

SEQ ID NO: 1268 - DNA, 189 bp, Homo sapiens
tcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtgg

SEQ ID NO: 1269 - DNA, 229 bp, Homo sapiens
atacaatgcatttcctcagtgatcactgattagaatgagttggtgggatccttgggaagccaaacggagcggagttctggatcatgtcccatccagtccagtgaatccacgacccgcagacctgcccccccgcaacagcttataccatggaatgaggacaaggtgatactctgagctgtggactgaactggcagacacaacctgtacagattgaaatttcaccttgtaa

SEQ ID NO: 1270 - DNA, 219 bp, Homo sapiens
  misc_feature (172)..(187): n is a, c, g, or t
tctcaagacattccactcacagatttgaggttctggattccaggtctggagttttcccatgttaatgtaaacagaactggcacacacacattaaagatgaatgtaattattattcctcttgctggtcactaccgtcgctttctatttctctttctttgtgtgaatttatttnnnnnnnnnnnnnnnnccttttgtaacgactatttgcagtttaaaatc

SEQ ID NO: 1271 - DNA, 240 bp, Homo sapiens
  misc_feature (200)..(215): n is a, c, g, or t
gagaaaccctttgacttccacgtgcccatctcaagacattccactcacagatttgaggttctggattccaggtctggagttttcccatgttaatgtaaacagaactggcacacacacattaaagatgaatgtaattattattcctcttgctggtcactaccgtcgctttctatttctctttctttgtgtgaatttatttnnnnnnnnnnnnnnnnccttttgtaacgactatttgcagtt

SEQ ID NO: 1272 - DNA, 249 bp, Homo sapiens
  misc_feature (65)..(73): n is a, c, g, or t
tttattcctcctgctcatattgtgattctgcctttggggacttttcttaaaccttcagttatgannnnnnnnncatacacttattggaactctgcttgatttttgcctcttccagtcttcctgacactttaattaccaacctgttacctactttgactttttgcatttaaaacagacactggcatggatatagttttacttttaaactgtgtacataactgaaaatgtgctatactgcatactttttaa

SEQ ID NO: 1273 - DNA, 37 bp, Homo sapiens
gaatcagtcggcagtcatgctgggtctccacgtggtg

SEQ ID NO: 1274 - DNA, 240 bp, Homo sapiens
ggtattgcttcaaactggtgtctgagatttggatccctggtattgatttctcaggactttggagggctctgacaccatgctcacagaactgggctcatagctccattttttgcagaggtgacacaggtaggaaacagtagtacatgtgttgtagacacttggttagaagctgctgcaactgctctctcccatcattataacatcttcaacacagaacacactttgtggtcgaaaggctca

SEQ ID NO: 1275 - DNA, 266 bp, Homo sapiens
ggatcagaatcatgccttccaataaaggcctttacacatgttttatcaatatgattatcaaatcacagcatatacagaaaagacttggacttattgtatgtttttattttatggctctcggcctaagcacttctttctaaatgtatcggagaaaaaatcaaatggactacaagcacgtgtttgctgtgcttgcacctcagtaaacctgcattgtagcaatttgtaaggatattcagatggagcactgtcacttaacattctctggg

SEQ ID NO: 1276 - DNA, 59 bp, Homo sapiens
tagaaaaccagcttgcgaataacagtccccgtggccatccctgtgagggtgacgttagc

SEQ ID NO: 1277 - DNA, 227 bp, Homo sapiens
gtgatggtaatgatattgtgcaagtggatggaaaaagaatatacgtatttgcaaatgcatggaaaatcttattctgtgggccttgtctgaattttaaactgataccaagaataaaaaaatatagtagcacaagtccattgacacctggagggtcaggcctagaaagcttaccttcaaagtgcaaattttaacaatggaatgttttagcagggacttaagcctcgtgc

SEQ ID NO: 1278 - skipped

SEQ ID NO: 1279 - DNA, 131 bp, Homo sapiens
ggagcttttggtggtagatcccctggtgtctccaacctgactaggtggacagagctcaaagaggccctcttaccgctagcgaggtgataggacatctggcttgccacaaaggtctgttcgaccagacatat

SEQ ID NO: 1280 - DNA, 272 bp, Homo sapiens
agcggcctggcctcgcttggttttgtggggcagcatacctcgcacggtccgccagaagatgcggctgggggcccggaagtggtaggggcctcgggaagggttggtgttcatccgcttgcggaggaaagccaggtacttcaacttgtttctgtagaaattgccagaaatgttgatgccttcacagcgtacgaccaccaccttccggcccagcagtacctgtttagccacgatggccgccaggcggcccaggagatggcctcgaccatcaagca

SEQ ID NO: 1281 - DNA, 279 bp, Homo sapiens
ttgtgtctgaaatgtgagccacgtagtgtcggcctgctgtgaagttaacattgccaggacgattcttctacagaaataatttcaatttttttcagtatttagtagtgaaagatattaatacattaatggtaatacatttctggtttaatataaattaaggatgttttctagttgtgcatgaatgctggcaacttagtaagttttgacaattgtttaaatatgtaatgttaagcttaggtttaaaaaagtaaagctggtaaactgggtctttgtcatttg

SEQ ID NO: 1282 - DNA, 277 bp, Homo sapiens
cagtagtggcaggatctattggcatattcgggagcttcttagagggatgaggttctttgaacacagtgaaaatttaaattagtaacttttttgcaagcagtttattgactgttattgctaagaagaagtaagaaagaaaaagcctgttggcaatcttggttatttctttaagatttctggcagtgtgggatggatgaatgaagtggaatgtgaactttgggcaagttaaatgggacagccttccatgttcatttgtctacctcttaactgaataaaa

SEQ ID NO: 1283 - DNA, 223 bp, Homo sapiens
  misc_feature (50)..(58): n is a, c, g, or t
tttgtaaggaggtgccaaatgacttagcactgttttccactctgtatctnnnnnnnnngttgcaatttgacagtaagcctatttaaaaaatattcttacattaattcatctcaaaaggttctattaatagtccttttgcaaaataccatatatataactgtgaacgttttttccagaattaatggaagaaaatgcatcctctgcacagatgaacattttctct

SEQ ID NO: 1284 - DNA, 229 bp, Homo sapiens
  misc_feature (42)..(50): n is a, c, g, or t
gaggtgccaaatgacttagcactgttttccactctgtatctnnnnnnnnngttgcaatttgacagtaagcctatttaaaaaatattcttacattaattcatctcaaaaggttctattaatagtccttttgcaaaataccatatatataactgtgaacgttttttccagaattaatggaagaaaatgcatcctctgcacagatgaacattttctctctaaaaccctcgtg

SEQ ID NO: 1285 - DNA, 243 bp, Homo sapiens
tccacttataatacttgtgattggggaggtttgtggaaattcaattatgatgaaaaacctatcttttttgtaatgttggcatacttggggaatttagtggcaaatacattccccagcaggccttttgttggttgcactaactgcaaggttgctgggaagtagagtccatttggttgatgagctttgactgcggttttggaaccttacctctcctccttagcccaatatgctgtcttgggtcct

SEQ ID NO: 1286 - DNA, 205 bp, Homo sapiens
gagatgttgatacgtgcaccactctcctcgcgcatcttcttaactgattctcctttctttccgatgatactgccaacttcctttccatgcataagtagccggatggtgagagtgacatttaatccaccttcaatcacaccggtgtccatgtcgagcagtgttctggggagctggactttgagtggtcaagtctttggtcactggt

SEQ ID NO: 1287 - DNA, 43 bp, Homo sapiens
gatgaaaagctgattactgttcaataaacagcttcctgccttt

SEQ ID NO: 1288 - DNA, 157 bp, Homo sapiens
caaactgcaatagagactgtagattgcttctgtagtactccttaagaacacaaagcggggggagggttggggaggggcggcaggagggaggtttgtgagagcgaggctgagcctacagatgaactctttctggcctgccttcgttaactgtgtatgt

SEQ ID NO: 1289 - DNA, 98 bp, Homo sapiens
tttagtaggtacgtcatgacaactaccatttttttaagatgttgagaatgggaacagtttttttagggtttattcttgaccacagatcttaagaaaat

SEQ ID NO: 1290 - DNA, 208 bp, Homo sapiens
tggggcttaccagtggcccaggtaattttttgtttcatggactatggactctttcaaagggatctgatccttttgaattttgcacagccctagatacaatcccttttgataaaagggtctttgcttctgattacaggagcactgtggaacgtctgtaaatatgtttttatatttccatgtatagttggtgtacactcaaaacctgtcc

SEQ ID NO: 1291 - DNA, 283 bp, Homo sapiens
gttgtagatacaatcagctgctttgttaccttaaaactaggcatttgtaaatattaaaccataagatggcaggtgatgtcctgtaaacactcagctgttcagattggacataactgacttagttcttcccttctctctctctcaaaattataggagacttgtagtttagtgtggttttctgtttctaatttgctgctgataatgtatatgaacttaacatgctgtgtaagctgtgtcctagttcttgaacagtttatgcagtgctgctttgccaaataaagtt

SEQ ID NO: 1292 - DNA, 60 bp, Homo sapiens
caaacgagtcctggccttgtctgtggagacggattacaccttcccacttgctgaaaaggt

SEQ ID NO: 1293 - DNA, 75 bp, Homo sapiens
gatcatgtcttttccatgtgtacctgtaatatttttccatcatatctcaaagtaaagtcattaacatcctcgtgc

SEQ ID NO: 1294 - DNA, 168 bp, Homo sapiens
ttttggccctgcagcatgtcatgctcccagaatttcagcttcagcttaactgacagacgttaaagctttctggttagattgttttcacttggtgatcatgtcttttccatgtgtacctgtaatatttttccatcatatctcaaagtaaagtcattaacatcctcgtgc

SEQ ID NO: 1295 - DNA, 219 bp, Homo sapiens
ggcagaaatgagcagttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccct

SEQ ID NO: 1296 - DNA, 43 bp, Homo sapiens
ctgtacctctcaacttttgccctatctgttaaatatatgctat

SEQ ID NO: 1297 - DNA, 236 bp, Homo sapiens
gttactctaatggttacttgctcgtgcgttgccacactgtgttataatttgcttcatttccttgctatttgatacatagtgtgcatttctctgtcactgtaactattgtaatgacaaattttcatcttactgcacaatcaaaatgacattgataggaatgaactccagaggctgggcctgaacagggaggtggtcgctcaggcctggtgctcagtcgtacgacctgtacctctcaa

SEQ ID NO: 1298 - DNA, 216 bp, Homo sapiens
ctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatata

SEQ ID NO: 1299 - DNA, 221 bp, Homo sapiens
aatcacaaacatcagaatgcccagactgtaccgcacttcccgctactcagaggatttctcagctcctgccggcagagtccactcccttccgccctgggccttttggtgaaagggttactgtgagtgagtcccaggcctcgctctgcctggctttcttcccaaatctgctgctggaaaaacaaggctccagcttgcaagccctcattggacaaatgagtcca

SEQ ID NO: 1300 - skipped

SEQ ID NO: 1301 - DNA, 177 bp, Homo sapiens
tgaaaacttcctttctgagaagttagtgttaaggtcttggaatgtgaacacattgtttgtagtgctatccattcctctcctgagattttaacttactactggaaatccttaaccaattataatagctttttttctttattttcaaatgatttcctttgctttgattagacactatgt

SEQ ID NO: 1302 - DNA, 246 bp, Homo sapiens
caagctagtgctttgtcttagtagttttaagaaattaaagcaaacaaatttaagttttcttgtattgaaaataacctatgattgtatgttttgcattcctagaagtaggttaactgtgtttttaaattgttataacttcacacctttttgaaatctgccctacaaaatttgtttggcttaaacgtcaaaagccgtgacaatttgttctttgatgtgattgtatttccaatttcttgttcatgtaag

SEQ ID NO: 1303 - DNA, 182 bp, Homo sapiens
gctctttggactttcttttattatgctaaaatagtggtgcttttaggatttacattattgtactctccaatacaaagtatggggcatgttaaagtatacagtacaccattttcatacatgtacaacattggtggatgaagaatgtctcttagcagtaatactggaggtagccctcgtgccga

SEQ ID NO: 1304 - DNA, 213 bp, Homo sapiens
agcgaagttatctggagtagtctatataggagctctttggactttcttttattatgctaaaatagtggtgcttttaggatttacattattgtactctccaatacaaagtatggggcatgttaaagtatacagtacaccattttcatacatgtacaacattggtggatgaagaatgtctcttagcagtaatactggaggtagccctcgtgccga

SEQ ID NO: 1305 - DNA, 279 bp, Homo sapiens
tttttgatccattattccaattaagaatgcgtgtcaaaacctaatttgttatttttctaatgagtttaagatttggcattcagttgttacacatgtggttcaatgatttatcatgaaccctaaactgcacactgctcaaaaacagcaaaacagatgtgcattaaatgaaataatgtttttgatacatatcttaaatttcaatcagtttagggtcctttgaaggaaaagatatccagttatcgggtggcaaagagcagaggaggtaaactcctcgtgccg

SEQ ID NO: 1306 - skipped

SEQ ID NO: 1307 - DNA, 144 bp, Homo sapiens
tcaccgccgggatcttgggtgacctgggctccgggggcaatgtggacgcatgtgtgatcacaaagactggcgccaagctgctgcggacactgagctcacccacagagcccgtgaagaggtctggccgctaccactttgtgcctg

SEQ ID NO: 1308 - DNA, 248 bp, Homo sapiens
atgtgggctccaacaagtacggcgtgtttatgcgagtgagcgaggtgaagcccacctatcgcaactccatcaccgtgccctacaaggtgtgggccaagttcggacacaccttctgcaagtactcggaggagatgaagaagattcaagagaagcagagggagaagcgggctgcctgtgagcagcttcaccagcagcaacagcagcagcaggaggagaccgccgctgccaccctgctactgcagggtgag

SEQ ID NO: 1309 - DNA, 244 bp, Homo sapiens
taggaaagggaaccaaatctcattaattaattgttctcccccattaccccactgaatgaatggccatacaggctaagctgaataatgacaaagttgaaaggaccaatacagccccttttataaggattttgaatgttttgcaaatgtattggtccctgtgttgtattttgtagccttttcctgggcttcagctcccctacttcttgtatgtgtatgcatactgtagctaaccattaaagtcatg

SEQ ID NO: 1310 - DNA, 281 bp, Homo sapiens
aacaatcctagtttgatactcccagtcttgtcattgccagctgtgttggtagtgctgtgttgaattacggaataatgagttagaactattaaaacagccaaaactccacagtcaatattagtaatttcttgctggttgaaacttgtttattatgtacaaatagattcttataatattatttaaatgactgcatttttaaatacaaggctttatatttttaactttaagatgtttttatgtgctctccaaattttttttactgtttctgattgtatggaaat

SEQ ID NO: 1311 - DNA, 182 bp, Homo sapiens
acttggggggcagacttgacactaggccccactcactcagatgtcctgaaattccaccacgggggtcaccctggggggttagggacctatttttaacactagggggctggcccactaggagggctggccctaagatacagacccccccaactccccaaagcggggaggagatatttattttg

SEQ ID NO: 1312 - DNA, 257 bp, Homo sapiens
aagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgc

SEQ ID NO: 1313 - DNA, 126 bp, Homo sapiens
gttctaaattagttccattctggagctggctacaaatgggtaaagacctactttttatacgacttcgatatttgactggtgcctggaggcttgagcaaactcggaaaatgaattaggttgtttgca

SEQ ID NO: 1314 - DNA, 79 bp, Homo sapiens
accggttgtaaaaacagtacacatgtcattttgtgatataggactcccaaataaaagtatcagaataaacacctcgtgc

SEQ ID NO: 1315 - DNA, 248 bp, Homo sapiens
gtatcttcatacacgtttggaaatgtttcctgcagcattaggtatgacttgttctgagtactgcttccggtgctaaaatgaacaaagaatttgtacttaatggcatggactctggagaatctatgcgaatcaacctttctaccttaatatctccccaaaaatgtatagtgccttgtttttatgtacagtttatatacagaaaagtttgctctgcatttttgatgatggtttggaacattatctacaat

SEQ ID NO: 1316 - DNA, 228 bp, Homo sapiens
atgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgag

SEQ ID NO: 1317 - DNA, 258 bp, Homo sapiens
aacaccatcgtgtgcaacagcaaggacggcggggcctgggggaccgagcagcgggaggctgtctttcccttccagcctggaagtgttgcagaggtgtgcatcaccttcgaccaggccaacctgaccgtcaagctgccagatggatacgaattcaagttccccaaccgcctcaacctggaggccatcaactacatggcagctgacggtgacttcaagatcaaatgtgtggcctttgactgaaatcagccagcccatggc

SEQ ID NO: 1318 - DNA, 184 bp, Homo sapiens
caatgccagattcctgttttgcgcattgtcatgggattcttaagtgaacctttctaaatgtggtcttgttcacatgctccacgtagctgtaacttcacatcatcagcttgcagtttgtaattgactaaagcattccagtgtcctctttctagattgccagctcatgacatggtgcttataaaga

SEQ ID NO: 1319 - DNA, 280 bp, Homo sapiens
gagagaagcaaccaccacaagctctcgggactagctgccttcgcaccttgctgtgtgacctgaggccctcactgagcctcaatttcctcatctgggtctcccaggacacatcacatacccacccttacttcctggcctcttctgggctactgccactgtgtgccttctgccaacgcctcctgtccccacctaagcctggtgggggtgaggggctccgggtcactgctgtatataactcccctcccccagaaaaataaatgtcactgccaacgtcctcgtg

SEQ ID NO: 1320 - DNA, 235 bp, Homo sapiens
tgaaatcaaaattgtgtgctggtctaaatatacatcttcggcttcttcctttttagtaagtatttttatttcagatgtatttaaaaataacttacatttttagtgtgctttatggtcaatgactgtaaagttgaaactcaaatgagtcagtttaaaatttttgtctcatttgattctattgaaattttaatcacctactactttaatcaagttattcatgaggtaagtttcagct

SEQ ID NO: 1321 - DNA, 233 bp, Homo sapiens
agaaaggcgatgaccagagccggcaaggcggggctcctgatgctggccaggagtgagtgctaggcaaggctacttcaatgcacagaaccagcagagtttccccttttcctgagccagagtgccaggaacactgtggacgtctttgttcagaagggatcaggttggggggcagcccccagtccctttctgtcccagctcagttttccaaaagacactgacatgtaatttttctc

SEQ ID NO: 1322 - DNA, 76 bp, Homo sapiens
agctctgtcttttgcgtgtcgagactgaaaacctcctcctggtgtcctcatggcttcctgattgacactgctctgt

SEQ ID NO: 1323 - DNA, 280 bp, Homo sapiens
agctctgtcttttgcgtgtcgagactgaaaacctcctcctggtgtcctcatggcttcctgattgacactgctctgtcttctcttgcagagttggatctgtagcggtcctttggagagtgtgtgtggcgggagagtgaaaccttgggggaaaatgctaggagattcttttttctttttgttctacttttcgctcggaaagtttttaaatcctcatttggtgcatctgtattccagccaataggtgtgccagttttcatgtaatctttactggcccaacttg

SEQ ID NO: 1324 - DNA, 250 bp, Homo sapiens
ggctcattttgccagggccaagctaccagaaaagtagaagtggagattacctggtatgtatctctctgggtgccccagttagagctgccacagctcaggaaaaagatgaggcataacgaccttgaatgtaattggagtaagtgacaaaataagaactaccctgggaaaccctgcattcaatgtagctgtcaattcagtatttttaagtacacctgtcagctgtttcttaccacttcgatggttgtgatta

SEQ ID NO: 1325 - DNA, 249 bp, Homo sapiens
gatgtgtgttgttgatgttctatgttttgttttgagtgtagcctgactgttttataatttgggagttttgcatttgatccgcatcccctgtggtttttaagtgtatggtttcagaactgttgcatggatcctgtgtttgcaactggggagacagaaactgtggttgatagccagtcactgccttaagaacatttgatgcaagatggccagcactgaacttttgagatatgacggtgtacttactgcctt

SEQ ID NO: 1326 - DNA, 186 bp, Homo sapiens
atattcacctagcaacatatctctgccgtctctcctgctctcataatgaagacatagccgattctctgcccgggccccttgctgatgctcctccgggtctgcgtcgggcgtgggtctctggggaccctccagaggtggaggtgggctgatggcctggctgcctggtggttgatggttttgcctcgt

SEQ ID NO: 1327 - DNA, 175 bp, Homo sapiens
atgtatattcttaactggactgtcttgtttagactgtatacatcatatccgacattattgtaactaccgtgtgatcagtaagattcctgtaagaaatactgctttttaagaaaaaaaataacatgctgaggggtgacctatatcccatgtgagtggtcactttatttataggatc

SEQ ID NO: 1328 - DNA, 251 bp, Homo sapiens
  misc_feature (145)..(189): n is a, c, g, or t
tacatgaatttaatacacgtgttcttaacaattatgcttggattgttcatgaaaatttcataagacattaaacaaagctagccatcatctcaagttatttccctgttaactatttttacagcacatgcatgttaggcaagtatcnnnnnnnnnnnnnnnnnnnnnnnnnnnnnnnnnnnnnnnnnnnnngttaaatacatgggtttttgttttactgctgtgcttgatatacatgaagtaatgcctcgtgc

SEQ ID NO: 1329 - DNA, 267 bp, Homo sapiens
  misc_feature (161)..(205): n is a, c, g, or t
aaacttttattccacttacatgaatttaatacacgtgttcttaacaattatgcttggattgttcatgaaaatttcataagacattaaacaaagctagccatcatctcaagttatttccctgttaactatttttacagcacatgcatgttaggcaagtatcnnnnnnnnnnnnnnnnnnnnnnnnnnnnnnnnnnnnnnnnnnnnngttaaatacatgggtttttgttttactgctgtgcttgatatacatgaagtaatgcctcgtgc

SEQ ID NO: 1330 - DNA, 240 bp, Homo sapiens
tgaagacatctaccagtttctccaaatgccttttttaaaactcatcacagaagattggtgaaaatgctgagtatgacacttttcttcttgcatgcatgtcagctacataaacagttttgtacaatgaaaattactaatttgtttgacattccatgttaaactacggtcatgttcagcttcattgcatgtaatgtagacctagtccatcagatcatgtgttctggagagtgttctttattc

SEQ ID NO: 1331 - DNA, 282 bp, Homo sapiens
gctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctcgtgccgaa

SEQ ID NO: 1332 - DNA, 253 bp, Homo sapiens
atttttctgtcatttagcaccatgctgcttctgtctgtcttaatgctggcattaagatcatgagccctttttctccagtagtacaggctttgaaaactacttctattaagttattgatgcaatttgatattttttcataatctatatttaaacaaaattacatcattgcatcatcttttctaaattcatctccattaaaacttgccttaagctaccagattgcttttgccaccattggccatactgtgtgttt

SEQ ID NO: 1333 - DNA, 259 bp, Homo sapiens
  misc_feature (180)..(203): n is a, c, g, or t
agaaggcatattcagagttctttttaaataaatgttgtttacttttataggcatctttaaacttctggattttggtatgccatttaaaaatacttccagatacacatggaaattagtaatactgcagccgtatccttgcaaacacatctgtcagtgtcaaaggtttcaaggtttttcttnnnnnnnnnnnnnnnnnnnnnnnncacctatactgcccaaatgggaggattagatacatggttagaaatccctcaggaaa

SEQ ID NO: 1334 - DNA, 80 bp, Homo sapiens
gaatctaaaccttacatgtgtaaaggtttcatgttcactgtgagtgaaaatttttacattcatcaatatccctcttgtaa

SEQ ID NO: 1335 - DNA, 85 bp, Homo sapiens
aatacaagtactggttgaacctgaccacttcaaggttgcagtgaatgatgctcacttgttgcagtacaatcatcgggttaaaaaa

SEQ ID NO: 1336 - DNA, 265 bp, Homo sapiens
atatgtaattggtcacaaggcctaatttgcagtaactattgctgttttatttaacaatgccttgttgctttgtatgcattaatgtttggatgtaaagattgtgtgtctatccaacagggagccacagtatttaaattgaccaacctaatgttacaactactttgaggtggccaaatgtaaactaaaagccttaattaaagtggtgcaattttgtataacttagcatcagtagttcaataaatttggattgccatgcaagggcttg

SEQ ID NO: 1337 - DNA, 182 bp, Homo sapiens
catttatgcatatttctctatactgtcttttacatgcacaagacatttgaagtaatatactgtaaaactgtacaattaaaattataaataaaatgtaagaccatgacatgaaatccaaacagtacatggatgaattataagaagattagctaatctgctagcagttatcttttgtaatacta

SEQ ID NO: 1338 - DNA, 199 bp, Homo sapiens
gcctggcccaattactttcatttatgcatatttctctatactgtcttttacatgcacaagacatttgaagtaatatactgtaaaactgtacaattaaaattataaataaaatgtaagaccatgacatgaaatccaaacagtacatggatgaattataagaagattagctaatctgctagcagttatcttttgtaatact

SEQ ID NO: 1339 - DNA, 274 bp, Homo sapiens
cctgtgcacagtctgacactgggaatgagtgacctttgtgttccctgagaagagagagtgcgctctagggaatttagaaggatgtgtctggagcttgtgagcaggcacagaagggcccttaggagcctaactgcttccttcctccttccgcggaggaggctcctgtgcaggaatctgggctcccctgagctgtggaagagctgaacatggggcagcccctggcgaggttggggcaggaccgggcaggggactgagattgcagtctcatcttccc

SEQ ID NO: 1340 - DNA, 291 bp, Homo sapiens
atggattaacctcgttaacaagaagaaaaggcaattgtgatttctaaagtggaaaggcaggtaggttgcaaagactcccctacactgaaaatacgattcttttccattctcagctgtaattgctgaaagctcaagtaataggctaaggtaacatacaaggcctaaaaccttattcctttatcattcagtactgaacgttcctctaagagactgcactttttcccgccacctcaaaaacagccctgaatcaagcctggcctgcccacttcagcaacactagcccagctacag

SEQ ID NO: 1341 - DNA, 262 bp, Homo sapiens
  misc_feature (47)..(56): n is a, c, g, or t
gtaactgcagacttcattagcacacagattcactttaatttcttaannnnnnnnnnaaatacaaggagggggctattaacacccagtacagacatatccacaaggtcgtaaatgcatgctagaaaaatagggctggatcttatcactgccctgtctccccttgtttctctgtgccagatcttcagtgctcctttccatacagggatttttttctcatagagtaattatatgaacagtttttatgacctccttttggtctgaa

SEQ ID NO: 1342 - DNA, 282 bp, Homo sapiens
agttgagaggcagatacattaaaaaccactataaatcacaatgaattaatattaatatctataatacccgaagattcttttcaatctagaaatgttttggtttagtaactgctactgaaaataatttataaaaggaaatagaaagtatctcaggggaaactaccctttccttgactactgatctttttcactgatcttatcaaaattaaagaggctctgccctgaaggggaattgctgtcattaatacttaaagtatgtcgctaagatttaaagtaactcaa

SEQ ID NO: 1343 - DNA, 276 bp, Homo sapiens
gaggcagatacattaaaaaccactataaatcacaatgaattaatattaatatctataatacccgaagattcttttcaatctagaaatgttttggtttagtaactgctactgaaaataatttataaaaggaaatagaaagtatctcaggggaaactaccctttccttgactactgatctttttcactgatcttatcaaaattaaagaggctctgccctgaaggggaattgctgtcattaatacttaaagtatgtcgctaagatttaaagtaactcaa

SEQ ID NO: 1344 - DNA, 102 bp, Homo sapiens
attgctaaaatatgtgtctattaaatcaatgtactcaatgtacatctctgtggaaatcttctctctgtacctaacctctgatatgttttctgaaggatgagg

SEQ ID NO: 1345 - DNA, 195 bp, Homo sapiens
gatggagagaatgcccacccatatagaaacagtgaccctgtgattggggacccacacagagaaagtgtccctcaaagccagtgactccatggatagtctctacagtggacagagctcatcaagtggcataacaagctgttcagatggtaccagtaaccgggacagctttcgactggatgacgatggcccctattc

SEQ ID NO: 1346 - DNA, 274 bp, Homo sapiens
gcaagtatgccgttctggtgaagatcatggggcaaagtgaattttgattcttgagtttctgtgggccagaaatccaggtgggctgaactgggtcgtctgctgcttagggtctcaaaacactgaaatgggatgtcagcagagctgtgtgccttattagaggttttggtggggaagaatccacttccaagctcacttaggttgttggccttgtggttgcaggtctgaggtccttgttttcttgcaggcagttatccaggagctggtccttgctcct

SEQ ID NO: 1347 - DNA, 249 bp, Homo sapiens
gaagtgaaataatcatgcctgccctggctgcttctgtgagtggaagatcataattggagtgcatgaaagactttgtaaactgttaagtgctctataaacgttagcattttactcaataaatttttatcacacattcgatggaataaggaaagagaattgaaataatacagtttttcttcattgccttagattataattcagatataatacagttcattacatttcatagttgtggctatttcagtaaat

SEQ ID NO: 1348 - DNA, 247 bp, Homo sapiens
agtgaaataatcatgcctgccctggctgcttctgtgagtggaagatcataattggagtgcatgaaagactttgtaaactgttaagtgctctataaacgttagcattttactcaataaatttttatcacacattcgatggaataaggaaagagaattgaaataatacagtttttcttcattgccttagattataattcagatataatacagttcattacatttcatagttgtggctatttcagtaaat

SEQ ID NO: 1349 - DNA, 101 bp, Homo sapiens
gtatgttcaaataagctttcagactaatagcttttttggtgtctaaaatgtaagcaaaaattcctgctgaaacattctagtcctttcatttagtataaaga

SEQ ID NO: 1350 - DNA, 244 bp, Homo sapiens
attccccttcctggtactgtggagtcagattggcatgaaaccactaacttcattctagaatcattgtagccataagttgtgtgctttttattaatcatgcctaaacataatgtaactgggcagagaatggtcctaaccataggtacctatgaaaagcgctagctatcatgtgtagtagatgcatcattgtggctcttcttacatttgtaaaaatgtacagattaggtcatcttaattcatatta

SEQ ID NO: 1351 - DNA, 274 bp, Homo sapiens
ctgggcgaatctcctccaaggaagtcccaggaggatggggaccaggaaggctgtggacccccatctccagggggccttcccagcctgatccctgtcctccaagttctggaggaggccggtgtagggtctggctgaacttcccacccactttccctggtcccaatcctttcttgtcctataccaagctggggttgctgccttgaacgaactgcgtgtgttttcgtcacatcctatcaggcagcccctggcgtctgctgcctcaggtatgctccaa

SEQ ID NO: 1352 - DNA, 218 bp, Homo sapiens
ctgtccgtgtttattgcagttctctggtttgtctggagtgtttgcaagtcagtcatcatagtggcagcttccgcctgctacaggatatttatatatggaagcataccatggcaggagtgctggaaaggtggtgtcagctaacagttgcttcagccagataaggacggtaacttcagtccaataaaaaacctcatcagttaccaactaaatcaaggcat

SEQ ID NO: 1353 - DNA, 217 bp, Homo sapiens
tgtccgtgtttattgcagttctctggtttgtctggagtgtttgcaagtcagtcatcatagtggcagcttccgcctgctacaggatatttatatatggaagcataccatggcaggagtgctggaaaggtggtgtcagctaacagttgcttcagccagataaggacggtaacttcagtccaataaaaaacctcatcagttaccaactaaatcaaggcat

SEQ ID NO: 1354 - DNA, 283 bp, Homo sapiens
cataaggagactaggcagccatgggtaacacctcacaaggaaatgagcgtgttatctgtatagtggtgtcactctggctgaatgtcaatttaggtgattacttaaaggccattcacctgatagggctgggggtcccaggggtgagaggtggggaggggattcttgctcaccttgaaatctgagctctgcaccaggaagcagaggtcaaagggcatctccttctggaaaggcatgtgtgtcttcctctccctcgggcccccagcttccgttctgcctcgtgttg

SEQ ID NO: 1355 - DNA, 267 bp, Homo sapiens
tttttattcctcttggaaatgcctaaaactacagcaagagaaattctagacttctggatttttatgcagatgatttaaaccagatgatcataacctttttatggaagcagtacgtatatttagcccccagggacctgagatccccagtgctccagaggagacgctctgcagaagaatgtgtgtgttccagaaaagggagtaggtcctctggtggcagctgctactgtgcagtttatatggggccagttagatagaggctgattggcc

SEQ ID NO: 1356 - DNA, 236 bp, Homo sapiens
aaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactatag

SEQ ID NO: 1357 - DNA, 270 bp, Homo sapiens
tgcccttaaaaatgtcagagtagtattattgataaaaagggcaagcaatagatttttcatgactgaataaactgtaataataaaacatatgtctcaaagtgtatcacatatgaatttagcctaattgttttcagtttcattctcaatatttagtttacaacatcattttcccctaaactggttatattttgacctgtatatcttaaatttgagtatttatatgcctaaatacatgtgtgagttttgtttgacttccaagtccaaactata

SEQ ID NO: 1358 - DNA, 297 bp, Homo sapiens
agatgtagttctccgtaggcagcaggtcatgtagcagtcattcttttacaacttctaggactttgtaaacactgttctggaatacagtggtgaagtgaggtttggaattcttcactaagaggttacataagggagttttcccagcattggcaggatcttctacatctcaaatttcagcatactgcaaccaggcttggatcttcttacacaccatgactcttctagaatgtaatagttcacttttaactttatcagttctcgcttcacttcttcggctgctttccgactatacattga

SEQ ID NO: 1359 - DNA, 256 bp, Homo sapiens
tcctgggcaacaaatctcaagtcctccatcagaaaggctaataaggctctctggctctctattgcattcattgtactgtttgcagctttgatgagcttcctcacaggccaattattccagaagtctgtggatgccgctcccacacagcaagaggactcatggacgtctctagaacatatcttgtgtcatttaccagactcgacacaatgggccaccaccagtgtgacagcagacatcctaatatatggatcttgat

SEQ ID NO: 1360 - DNA, 139 bp, Homo sapiens
tctggggtgttttgcgcgtgtgtaaataccggcccgtttttctccagcatggcccctaatccatgggacactagggaggggtgccctgagcaaaaattttttggctaaaataattagctaaatcccatgtaaaaattat

SEQ ID NO: 1361 - DNA, 254 bp, Homo sapiens
tgggcgcatctagttagaatgaagtgactttcgtaaggagtcaatgttcgcgaactgaaacatgagttcaacctccttgtgccggcctctggggtgttttgcgcgtgtgtaaataccggcccgtttttctccagcatggcccctaatccatgggacactagggaggggtgccctgagcaaaaattttttggctaaaataattagctaaatcccatgtaaaaattatggaatctagcaaaacctacaccatattt

SEQ ID NO: 1362 - DNA, 210 bp, Homo sapiens
ctttatgttcaataccaggttcttttcatttctctggattattttgcaaatcattggacagagaatttgggaatataaatctgtaacaggtgtttgacaccagtaagtctctttatttctgggaaatgtgtacctgtactttctgatatacagtgttcctaagtaaaaatcaattcacgggatttgtatagtgtctataggaaagtagcc

SEQ ID NO: 1363 - DNA, 237 bp, Homo sapiens
aactccctctgctgactatttggaatggactgaatgaggaggtctctccagccagaaggagtattgaggtcatcaggcctcagaaaacaatgtacacataatctcgggctgtgaacaagagaaaggagggggggaaacatgaaagtcaatcttaacaatttttgcaatacctcttatttgcagaccattggatttatgttattgcactctcggtgtgatttatcgtatgtatctgat

SEQ ID NO: 1364 - DNA, 221 bp, Homo sapiens
  misc_feature (28)..(36): n is a, c, g, or t
ggttcggcattcatgtgtattccattcnnnnnnnnnctctgtactttcttttcatacatttcttgtctctgcaatgaggctgagcgagactgtcccaaatgtgtttttatcctgagtctgaggcaggctgaactttaatctgcatgatgtgctgcagcttgccatcatgtcgggacagcagatccagtcccttgagtaagccagttggtcacagtttcaga

SEQ ID NO: 1365 - DNA, 257 bp, Homo sapiens
accaaaggctaccttgcctaaaatgttagtggctgaggacccaagccttctgcctctagcacagtgctctaaactaggccctgaaggatgtgtcgggtcaagccactggggaagcatccgaagggataccacctaggcagtacagggaaaaagaggaaaggacccaggaggttgctgagtcaccgtgtgcccagtcacatgccagtttcctcccaggggctgctgagctttcaagtgcttcagggtgctgagcagtc

SEQ ID NO: 1366 - DNA, 290 bp, Homo sapiens
tatttaccattttactatccagagatgataatcactctgctaacatgtttttgattatatccttccagatggatttttcttttctctactctttctctgtctctcagcctctgcttttaaagtggtttaaaatatgtaattttcagtttttaatgattctgctagggcgaaaaattggcagctacataggaaagttgctgaagcggaggcaaggaatcaaagatttatccttctctgatataaaaacttacccattttttcaagtgtaaggcatattgcagccactaata

SEQ ID NO: 1367 - DNA, 55 bp, Homo sapiens
gggaggaagaactggtgaaatgaagtgagtgcctttgagaattgaatgaatttaa

SEQ ID NO: 1368 - DNA, 87 bp, Homo sapiens
gtaaaacaccattcaagtgtcagaatcattattttccaccacttatcatggtgcttgacaagtcttcccaataaatactgaatgaac

SEQ ID NO: 1369 - DNA, 267 bp, Homo sapiens
aggttaaagcagttgggagtccatacacagcctacccaacttcctgaaactcttagagaggaaaaggcatccttaggcatccttcctgtgaagtttgcctattccgtgatcacgctgagaagatgggaactctgaagtttgcttcacaagaaggtaaaatccttaaagggaggcaccttgctgtgccactgttcagttttactataacatcaatctttttttagtttttattcccacctcaagaggctgagttgaatactattaggc

SEQ ID NO: 1370 - DNA, 272 bp, Homo sapiens
agaaatatgccttgccttcagagaatttatagaaagtctatctgtcagtgctagggtgctaggggctgggaggagctgagagcagctctaaagccaggaagctggacctaaaacagatggctattgagcgaagtatttgaagctagatgatgtgtaagtaataatattctctgagcacctctattattattttttaggttctctgcatcagaatgaggaaagagatttaataagttgtgaattttaaattcatgagaatgccaatagagacc

SEQ ID NO: 1371 - DNA, 290 bp, Homo sapiens
ctgtgagagcatgaagctgcaacaagtcagtaggggagcaaacaaatattgattcagatcacgccacagaagagacaagctggagcaagtgctgtgtgtccctcctgctcagtttgatcgaggtcactgggccgaattccaggaattctggggaatgagttggccctgtgactcagtcattaatcaagaccataaaaccaaggagaagaatatctgctttcaaaaaggttctgataataaagatgcagtacgtgggtggaggatggagtacagtgggaacccctcttctc

SEQ ID NO: 1372 - DNA, 147 bp, Homo sapiens
agtggccattagctcccgtcaccactgcaacccagggtcccagctggctgggtcctcttctgcccccagtgcccttccccttgggctgtgttggagtgagcacctcctctgtaggcacctctcacactgttgtctgttactgatttt

SEQ ID NO: 1373 - DNA, 271 bp, Homo sapiens
gggagcagcacgaactcctgaagacttgggagcgtcagcagcttctgcggaaggggtggggctgagggtggagagaggaagggaaggaagaaaaggggagccttcctggccagggtaaccggcactaagaggcctcactccaagcccccgaggagcctgtggtggggctggagacccgggctcagcccctccaccacccttaaagtcctcagaaggtgggaactgaactgggcacaggctgggaaaccggctgtgcgctgggcacttggat

SEQ ID NO: 1374 - DNA, 281 bp, Homo sapiens
gagcagcacgaactcctgaagacttgggagcgtcagcagcttctgcggaaggggtggggctgagggtggagagaggaagggaaggaagaaaaggggagccttcctggccagggtaaccggcactaagaggcctcactccaagcccccgaggagcctgtggtggggctggagacccgggctcagcccctccaccacccttaaagtcctcagaaggtgggaactgaactgggcacaggctgggaaaccggctgtgcgctgggcacttggattttgccagctgc

SEQ ID NO: 1375 - DNA, 257 bp, Homo sapiens
gagtatttgtgaattaaatcctttatgaaaaggtgtcccttgtaaatgattggggcatgttgcctcttttccttcatatttttagtttctgctattcataagaaaataagaaaaatactaacttcccttaagagtaactacttaatgtccaaaaacccctcaggttctgcaactatgatgcactgatttatgatgtttatttatatacctctcagaaaatttgaaatgaccaagagatttacaaatgcaatgttcag

SEQ ID NO: 1376 - DNA, 271 bp, Homo sapiens
gagtatttgtgaattaaatcctttatgaaaaggtgtcccttgtaaatgattggggcatgttgcctcttttccttcatatttttagtttctgctattcataagaaaataagaaaaatactaacttcccttaagagtaactacttaatgtccaaaaacccctcaggttctgcaactatgatgcactgatttatgatgtttatttatatacctctcagaaaatttgaaatgaccaagagatttacaaatgcaatgttcagccaaaaatgttttt

SEQ ID NO: 1377 - DNA, 280 bp, Homo sapiens
acatactttgtgcatttttcactgatccaagaatgtttttagtcatttccttttcagtgtgtgaacagcctaacaattcactggagttgaaaagctttgttaaaacaaatttgaaatggcttaaaaaccatttagtggatggtatccactaaaactaggtatccactaaaactatgccttaaaagttaccttttaaaaaagacatgttcatcttcacaaggtcaattttcatgtattaaattgtgtatagtgctttaaagagctatattcctcaaaaata

SEQ ID NO: 1378 - skipped

SEQ ID NO: 1379 - DNA, 101 bp, Homo sapiens
gaagaagaaaagctcctgactaaatcagggctgggcttagacagagttgatctgtagaatatctttaaaggagagatgtcaactttctgcactattcccag

SEQ ID NO: 1380 - DNA, 195 bp, Homo sapiens
ggactgcagctaagtgtccactccccaaagtcttcctattcctaactccatgacagctcctcagtagagctttcctcctcagaagcaactagaacaatgcagttaacattatttggccccaacggcgtttactgtgtattttggctgagatctttagaagcccgaggcctaaacaattaactgaggaacatctaa

SEQ ID NO: 1381 - DNA, 167 bp, Homo sapiens
ccacacaaatgcaagctcaccaaggtcccctctcagtccccttccctacaccctgaccggccactgctgcacacccacccagagcacgccacccgccatgggagtgtgctcaggagtcgcgggcagcgtggacatctgtcccagagggggcagaatctccaatagag

SEQ ID NO: 1382 - DNA, 141 bp, Homo sapiens
ggcctctcatctcagtggatatatccctcccaaaaggaaacaagggcaaggcttatctttgtgtcaaaacggagagtcacccaactgtgtggaagacaagatgctctcgacagttgcagtacttacccttggctaagaact

SEQ ID NO: 1383 - DNA, 220 bp, Homo sapiens
agcagagggcgccaccaccacctgacggctggggacccacccagcccctctcccctctctgctccagactcacttgccattgccaggagatggccccaacaagcaccccgcttttgcagcagaggagctgagttggcagaccgggcccccctgaaccgcaccccatcccaccagccccggccttgctttgtctggcctcacgtgtctcagattttctaag

SEQ ID NO: 1384 - DNA, 105 bp, Homo sapiens
aggtgttatgtctggctgtagctgttggtcacgtgaagatgacagacgatgagcttgtgtataacattcacctggctgtcaacttcttggtgtcattgctcaaga

SEQ ID NO: 1385 - DNA, 265 bp, Homo sapiens
ttagggcctttgctctagccaaagcttcttgcaggaaagctcacatccagggagctgccagctaactcccttcttcaagattttcctcagctcccatcttctcagttagacttccaaggaccaccccgtctaatactgcatcctgcactctacccattcctcctgtctttttactctgctgtgccattcaccacagctcttatcctttcatgtatatttattgtgtatattgtttgtaactggcctccctctgctagagtgtaag

SEQ ID NO: 1386 - DNA, 156 bp, Homo sapiens
ccatgtactggtctgactcatgatacagtagtagaatcagtagaagtgatgctgtacagagctaggccctttttaaaaggcctgacagctgccatgttcactctcttgtacactggcaccatgacagaaggaagtccaggctatcctgccgaagca

SEQ ID NO: 1387 - DNA, 298 bp, Homo sapiens
tgggctgtcacttttgctggcgtcaccctgtgacttatccacgtacacctcgaaggggctcttggcgatgtgctggccagcaaagagcacagtaaccttatgagtccccgtcaactcggggacgtaccagacggagaaggtgcggttcttgtcgttattggcggtcacttttgcctcctcctggtgtccggccgggtcctccacgtacaccagcacctctccctggccagcacctctggtctccacagtgaactctacccgcttcttcacaatgcacgtgatcaaatcctgtagagtc

SEQ ID NO: 1388 - DNA, 268 bp, Homo sapiens
  misc_feature (101)..(101): n is a, c, g, or t
gggccctatgaacagaccattcctggggaccgaataccttgctttccacctgcaaaaaaagtctccctgggaaatcctggcccaacaaaagagctttgttntttccccccagcgaacaaagggtatttgtccctgaatgtgtgccaaaaaacacgtgtaaacactaacaaggaggctctcttggaccttcgaaaaaagggcaattggaaatctccggccccttttgaggcccttgactttcatggccctcatccccagtcgataaggg

SEQ ID NO: 1389 - DNA, 299 bp, Homo sapiens
  misc_feature (79)..(79): n is a, c, g, or t
gccgcgggcttcgtgaagatccgctgggcgcgctggtccaagctgctcatcgcgggcgtcacggccacgcaggcggggnctggtcttccttctggcgcacacgcgccacccgagcagcatctggctgtgctatgcggccttcgtgctgttccgcggctcctaccagttcctcgtgcccatcgccacctttcagattgcatcttctctgtctaaagagctctgtgccctggtcttcggggtcaacacgttctttgccaccatcgtcaagaccatcatcactttcattgtctcggacgtgc

SEQ ID NO: 1390 - DNA, 261 bp, Homo sapiens
  misc_feature (134)..(134): n is a, c, g, or t
  misc_feature (146)..(146): n is a, c, g, or t
gaaggtggaggtcactctccaaagaagcatctccaactactcttgggcaaggccatctctccagtagtcttacgcatgaggctaaacctcttctcttacctcaaagatggcttcagtatccctcccgttacctncaacagggcatngaaatgtaccaaaagcaacacacaggaggccacagtggggctgagaggacccaggtacacatgctgtttcctgcctggtttctccccacctctgccgtgtgtcatcaacgctcct

SEQ ID NO: 1391 - DNA, 255 bp, Homo sapiens
gaaactctgcccctccggaacaggagggtgaccccaggtcctggacaggtgtccagagtggtctgatacccttggcaaaccccctgccccctctccctccaggctgcaaactgttcagcatgaggctccagcaaatcccagcaggagaggtggggctgcccagcaactggttcttgtataaacataaacccattcgataattagcaaacagcccacttctaagataaacaaataggagatttggactccaaaagc

SEQ ID NO: 1392 - DNA, 252 bp, Homo sapiens
aaatcggtcgcagctagtgcactttgttcatcatatgtatctgtgacaggaactgagtcttaaatctccctgtctggcacatgggtgcgtgagtgatgtgaggtcaccgtctaacgcagcgtgtaattaggtgctgggaccagttgtgtccatccctggctggttccgtctgtaatgcaaagtatagtgtagggcatatggaggcagccggtatacatgcattgattgactgttgatactttccggatgtaa

SEQ ID NO: 1393 - DNA, 258 bp, Homo sapiens
gacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaattt

SEQ ID NO: 1394 - DNA, 256 bp, Homo sapiens
gacaccccatattcatcacaaaattaaagcaagaagtccatagtaatttatttgctaatagtggatttttaatgctcagagtttctgaggtcaaattttatcttttcacttacaagctctatgatcttaaataatttacttaatgtattttggtgtattttcctcaaattaatattggtgttcaagactatatctaattcctctgatcactttgagaaacaaacttttattaaatgtaaggcacttttctatgaat

SEQ ID NO: 1395 - DNA, 248 bp, Homo sapiens
gatcagctgaacagcagccatcagagaaatcaacagaaccaaagactaaaccacaagacatgatttctgctggtggagagagtgttgctggtatcactgcaatatctggcaagccgggtgacaagaaaaaagaaacagaaatcattaaccccagctgtgccagttgaatctaaaccggataaaccatcgggaaagtcaggcatggatgctgctttggatgacttaatagatactttaggaggacctga

SEQ ID NO: 1396 - DNA, 260 bp, Homo sapiens
  misc_feature (68)..(68): n is a, c, g, or t
ccatatgccaattaactttaacctaaaaaaatagagtgggagggaaccttgacattcggagaaattcnagtgtgccggtaacgctgaggagtgaggctgtttgtccaggaacgctgagctgggctcagacggtcatcagtgcagacgcagcggacgctgctgaggatggctcagtggtggggaggcgctccctcccgaggaggcctgtacgtctgtgtcctggcggctcgagctgggtcctccgggccagttcatgctcg

SEQ ID NO: 1397 - DNA, 248 bp, Homo sapiens
  misc_feature (134)..(185): n is a, c, g, or t
tttcttctgcaagtgcagactgtggtaaaacttttgttgcacgtctaggtttaaacaaaaattaaacctttaactgaggcagtgctaatactgtcacacgacaaagttctggccattatacaaaatgcacacgnnnnnnnnnnnnnnnnnnnnnnnnnnnnnnnnnnnnnnnnnnnnnnnnnnnnagaaccatctgcacatgatttaggcaacctggtacacagaaaaatgactgagttcttggccag

SEQ ID NO: 1398 - DNA, 111 bp, Homo sapiens
caggtattgaaacaagttaacttgcattcctatgtaagataggaggggctgaggggatccccagtgtttggaacataagtcactatgcagactaataaacatcaactagag

SEQ ID NO: 1399 - DNA, 283 bp, Homo sapiens
  misc_feature (33)..(33): n is a, c, g, or t
tccctgctatcctttttctcctttggaggtgcnccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagag

SEQ ID NO: 1400 - DNA, 52 bp, Homo sapiens
cggacgggacccagtgatacttgtatattacacagtcctgatttcagacaat

SEQ ID NO: 1401 - DNA, 119 bp, Homo sapiens
tgaggagcggctcagtgtcacctcccacagccaccggccctgacccttaatccagacaccgatggaagtcgacttttcatatctttctcctgaaatgaactctgttttaaattggaata

SEQ ID NO: 1402 - DNA, 213 bp, Homo sapiens
aagttccattgtgaacgtgcctggtgagtctactcttcgccgagatttcctgagactgcagcaggagaacaaggaacgttccgaggctcttcggagacaacagttactacaggagcaacagctccgggagcaggaagaatataaaaggcaactgctggcagagagacagaagcggattgagcagcagaaagaacagaggcgacggctagaaga

SEQ ID NO: 1403 - DNA, 291 bp, Homo sapiens
  misc_feature (249)..(250): n is a, c, g, or t
gtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagagggcacagatagagtgtccttggtaataagaagtcagagatttacaatatgactttaacattaaggtttatgggatactnncagatattactcatgcatttactctaatgctttatgcttta

SEQ ID NO: 1404 - DNA, 250 bp, Homo sapiens
gcactctagtggacaggagaaggaacgccttccaggaacctgtggactaggggtgcagggacttccctttgcaaggggtaacagaccgctggaaaacactgtcactttcagagctcggtggctcacagcgtgtcctgccccggtttgcggacgagagaaatcgcggcccacaagcatccccccatcccttgcaggctgggggctgggcatgctgcatcttaaccttttgtatttattccctcaccttctg

SEQ ID NO: 1405 - DNA, 239 bp, Homo sapiens
taatcggatgtcaggcagagaaaacgtcgaggtcactcgtcttcctgaagggccttggagaaaccgctgcccccgtaacactgactcagtccactggagacactaattcctgagctttctggcttcttactgggaggcatgactggacccatttacgtgaaggctcctggccggagcggggcacgggggtgcgggggcgccgctgcccttcagcaggagccgacaaactttcgcgggcg

SEQ ID NO: 1406 - DNA, 287 bp, Homo sapiens
gattggattaaagacctggcacttcagtaactcagcacgcttccacttcactcaacttaagagagttcattgacagtgttaggatgtgaaggctgggaaacacttattttgcttcaagagttccacttggctctcccaaataggtacctcaaaaactgttagcaagcggcatttggatgtcttgacaggggctttgcagggatttttagggttttttccacattgtccacattaatggttggcatgattgtgcttgcaggccaagaaatgatcataccccttgccaa

SEQ ID NO: 1407 - DNA, 230 bp, Homo sapiens
attgtatacagcgtcacctgcgaacagtgctggcccgagtctggggaatgcgggccgtgtgaggccagtgtgcgctactcggagcctcctcacggactgacccgcaccagtgtgacagtgagcgacctggagccccacatgaactacaccttcaccgtggaggcccgcaatggcgtctcaggcctggtaaccagccgcagcttccgtactgccagtgtcagcatcaacca

SEQ ID NO: 1408 - DNA, 258 bp, Homo sapiens
actggcactggcctccgttgggatcacacacggaacttaacgaaccctgagggtcgcattcacaagccaggcctgtctggtgtaacagggcagaaatgctaaagatgatatttctgcaaacatctgtcatcggggttttcacaaacgcttctgctgttctctagacatcggtatctctgaaaggtttcccaggcactgttggtgaccaccccatctcctgaacctcccacggtgaagatgtccagtgatttacagtat

SEQ ID NO: 1409 - DNA, 228 bp, Homo sapiens
tgtgctttcaaataactaacacgaacttccagaaaattaacatttgaacttagctgtaattctaaactgacctttccccgtactaacgtttggtttccccgtgtggcatgttttctgagcgttcctactttaaagcatggaacatgcaggtgatttgggaagtgtagaaagacctgagaaaacgagcctgtttcagaggaacatcgtcacaacgaatacttctggaag

SEQ ID NO: 1410 - DNA, 245 bp, Homo sapiens
gggccacagattaggttggagctctggatgtacatacatagtatgagcagtgggacgtgtttctgtcttaatgcaggcatcaagggtggagtgaagtcaggtcataagtgtcatgtccgcttgggttttgttttgtttttaatgtatgtagcagatgttacagtcttagggatccgggatgggagaccccactttagaaagggtcgtcactcctttaatcctctactcaacaatgtactctttta

SEQ ID NO: 1411 - DNA, 261 bp, Homo sapiens
  misc_feature (147)..(147): n is a, c, g, or t
  misc_feature (212)..(212): n is a, c, g, or t
ggctcccgagatgaaacccgacgtgaacaccacacccgcgcccgccgcaccaatgatctgataactctctagacaaaatagggggctcggtcgggagagtctgagccgccaaatcatctcaacaccgcttgctgcctcggcgcctcnctgtcgatgatgacatgcgtacacctctctcctcacgacgacaaggagccttaggtgggacgaanacacaacgcgcacgcaccaatcgcgcgagcatgcacacgtataagaccc

SEQ ID NO: 1412 - DNA, 286 bp, Homo sapiens
  misc_feature (152)..(152): n is a, c, g, or t
aatgcgccggcctaacaatagttataaaaaattggggggaggacaacctccccttccccctcccggatcccccgcccgccttttttttccgcactattatccgcctctgccccgccgcctcagaatacctctatcccgccgcggagaaattnattcgcgccccgtattttctgcccgccgcgaacacgcccgccaaccagtattctcgggaaaataatataatgggactcaaaaacaccgctccccgcccaaatacgaacgtcgcggtggttattacttctcgccc

SEQ ID NO: 1413 - DNA, 68 bp, Homo sapiens
tccagcagctggtccaacagtcgtatcctggtgaatgtctgttcagctcttctgtgagaatatgattt

SEQ ID NO: 1414 - DNA, 262 bp, Homo sapiens
caaggaatgcacaggtttcgactaccagaaaggggagtccttgggttctttcaaaaaattcgtgaggagagctgtctacagtggaatagggggtctccctggggaatgcaggccaagtccttttattttaacatgatgtccatgaagaggtttgccgtctgggcagccctgtcggcaaggagcgtgcatactgcgtttgtgtaattgtttgctgtatctcccttccctctgagctgtattgttctttaatggctgtcttgcc

SEQ ID NO: 1415 - DNA, 272 bp, Homo sapiens
gctctgatgtgctatgcttagctatctgtcagagattagtaaattataaaactcatgtgtactacttaagtttatatcttatgctagtttataagaacaattaaaaggacttagaagattaactttggtttcatggtctctgaagtcactgactgctatttcagcttgtttacccttacctagcattaagactccatctacttctgtgcagtatatgaaaatttttaaactttcatttagactggtggataggactgaccattacaaattgt

SEQ ID NO: 1416 - DNA, 300 bp, Homo sapiens
  misc_feature (47)..(47): n is a, c, g, or t
  misc_feature (52)..(52): n is a, c, g, or t
  misc_feature (72)..(72): n is a, c, g, or t
  misc_feature (99)..(100): n is a, c, g, or t
  misc_feature (113)..(113): n is a, c, g, or t
gcgtctcgtcagatatctctactgaaatgtggtgcgtgtcgcggggncgagnagacactcttctttcgactnactctacctgtgactatatatgtgtgnnctcgttccgcctnactacgcatttagcacactatccctcgttagtctctcgtctccccataatacgagtaccacgcgctcgtctgtcatatcagataggatacatagtctggggcctctcgtatgattcatttcgctcgcccgccacgagtaacaatcttgcgttcccaccctccttcgtccctctgtcgttggaaggcc

SEQ ID NO: 1417 - DNA, 273 bp, Homo sapiens
  misc_feature (138)..(138): n is a, c, g, or t
tgatctctgggctggggactgaattcctgatgtctgagtcctcaaggtgactggggacttggaacccctaggacctgaacaaccaagactttaaataaattttaaaatggcgccaggcccccccacgtaaaagaaaanaacttgttcggccgccctcggcccctcaaaaaacttttctaaaccctttcgtttgggcccccggggcccacttaggtaagggaaaaatggggcctaaacctgtttccctaggaaaatcccttggccatgaactaa

SEQ ID NO: 1418 - DNA, 224 bp, Homo sapiens
gttctgttatgttcatgtaaacctaaagaaacagtgtggaggcaggcgcgatcagccgaactctagggacttggtgttgcttggaaggcatccatacctgcattttgcattcttcgtatgtaatcatattgccaaagacaaactatttcatcatttattgtaaataacacttttccccagacctaccataaagtttctgtgatgtattgtcttccagttgcaat

SEQ ID NO: 1419 - DNA, 264 bp, Homo sapiens
aggctatactcaacacacgtgcaattgaaagcaggcgaggcaaaaccagggcagaggaaaggaaaggggtgtgtgtgtaggtatggatttatgggtaggtaggtcggtaggttagttgaagaggaggttctaagcagtataacctaagcctcttttctctttcttctgcttcaaacaccttaagaactgctcagggtagactggagacaaaagcaacagctcagaagtgctaaatcttgaagagcagccaaagcatgggcaaca

SEQ ID NO: 1420 - DNA, 286 bp, Homo sapiens
aggcagtctcagcaatgcctctgccctccctgcagcagtcccaaaatgaacagccacaccttggagggtgtggcttttctgtttcatgcggtgcaaaccctagcggctccacaccccagggactggcccccaaaaagcaaaaacactgctcatggcttggcaggtcctctagtatgtatttttatgtgatatcactattcagaactgtggtgtatactattctataaatttccactataggttggccggacatcctttaatgctgggtattaattcctcttattct

SEQ ID NO: 1421 - DNA, 189 bp, Homo sapiens
gtccatcaaagtgagacacatcggcctgatccccgtgaaaagctctcctgatgagcccctcacttggcagtatgtggatcagttcgtgtcggaatctgggggcgtgcgaggcagcctgggctcccctggaacatcgggaaaccaaggagaagaaggtcttcatcagcctggtaggctcccgaggccttg

SEQ ID NO: 1422 - DNA, 264 bp, Homo sapiens
aaaggcctctaacctgctggaagatagggaccaagttgagtattttatttcttctgtctacagcatccagcatagttctaattaaatacaattaggcaagtactcaaataagtcttgcctaattatatttaaagtaagtatcctgcttaagtgagagaaattcttggcagatcttacctctagtactattgtttagtgccaggatggaaggtgagtctctgaattagactttttgctgaaagaacgctcccagctgggcatgct

SEQ ID NO: 1423 - DNA, 276 bp, Homo sapiens
tcttgaagaaggtactgcccggccagatgggtggacctgatgtgctttgatatgcctgaggacaggtgggaggtgtattgaacacgtgtgggtgtgggtgataaggtgtctttttcaaagcctgaattagattttgtctatactctgggtctatgcaccacaacgaccctttcccaatactctgactcctctctttgtccactttcttaaaacacttattcaatgataaattgtgtctcactgagtttttccacccagtaggtgcatttgcaaaat

SEQ ID NO: 1424 - DNA, 250 bp, Homo sapiens
aaagcaggcactcagctggttttggagccaagcctacagcatcacatacctggcagcaaggaaaagagtcgggaaaaagaaacagaatctgttgcagaagtccccctcttctgcagggaggagttatgtaacagcagaagtggcctcctagcaagagaggctgcctggtttagaccagcagcttatgagcgatgatgaggacagccttcaggataggcatgaagctggacacctcgctgaagctgataca

SEQ ID NO: 1425 - DNA, 292 bp, Homo sapiens
ggcagtggataatcgtccggccttccccttcctcgcattcctcctgccacttttccacctgaagtatcagtttcaagaatgaccttttggaaccaggcacttctcgatgagaagcccatcctaggtactgaaactgttgcaccatcagataaccttcctgtggtcttgttagattgcatatcctaaaaatccggttgatcacatcacagtccattgaacaagacatacattccacttggatggggccatatcgtagcatcccttcctctggccagtactgagggcagccctg

SEQ ID NO: 1426 - DNA, 164 bp, Homo sapiens
gcgcgtcgttgcagttgcgccatctgtcaggagcggagccggcgaggagggggctgccgcgggcgagcagcaggggtcgccgcgagccgaaggccttcgagacccgcccgccggccggcggcgagagtagaggcgaggttgttgtgcgagcggcgcgtcctctc

SEQ ID NO: 1427 - DNA, 262 bp, Homo sapiens
gatattcacaaatcccttcacaaggcccacgtgcgaagtgaatgatctggaggtgcctgggcatctgtgttggaagggagtcaagactcaccagccagtcagtttgtgggctagagttgtcccacaaaaatcaggcatgttcacctcccctctgggcccctacagctgggactgatcatagcctcagattagaagaaatactgacttctaactctataagccagcactcctgggtaaggagtgaagctctgttggccatgcc

SEQ ID NO: 1428 - DNA, 203 bp, Homo sapiens
agaggagggacattgttccagattggggttgacttgcccatcatgagtcttgccctcaggccttggagaacaatcatttatgttttttatttcgtcggtaagacaccttaaggtttcttgttgcagtgaggcaccatctttgtgcagttggccgaggttttttatgaccttacaatgggtctttaagggcgatctattgatga

SEQ ID NO: 1429 - DNA, 241 bp, Homo sapiens
cccaaaccgcctccattatttgaagttttactttgttctccacttccatttgtgggatctccttcatgtgcctcagttgaatcatctggttttgataaagaattattccgaaaacgatcgaaattcccaaaactgctgcttcgctttggtttttgatgtttctccttctctgaaacattggatggctttctcttgagcattttgaattctgactactcctagtgagtgcactttctgctgt

SEQ ID NO: 1430 - DNA, 279 bp, Homo sapiens
aggcctcccagagagtaacttggaggttccatttgctattgactggattgtgtttgcttgaggagcctgtgaccacccgcagggacaggcagcctaggataaactggaccacccctgagtaaagcactccactcagtcccttggtccccacccctcagttagaactgctaggctttgggggatgggagggtggcaattattcttaacctcccgaaattcctgatgacccgataacaaggaggtatttagacatagaatgaggagctaatctttttccta

SEQ ID NO: 1431 - DNA, 187 bp, Homo sapiens
aggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgt

SEQ ID NO: 1432 - DNA, 261 bp, Homo sapiens
ggaatgactctagctacaataatacacagtatgtttaagcaggttcccttggttgttgcattaaatgtaatccacctttaggtattttagagcacagaacaacactgtgttgatctagtaggtttctatttttcctttctctttacaatgcacataatactttcctgtatttatatcataacgtgtatagtgtaaaatgtgaatgactttttttgtgaatgaaaatctaaaatctttgtaactttttatatctgcttttgt

SEQ ID NO: 1433 - DNA, 145 bp, Homo sapiens
ttcttctaaaatctggatgtcattgacgataatgtttatggagataaggtctaagtgcctaaaaaaatgtacatatacctggttgaaatacaacactatacatacacaccaccatatatactagctgttaatcctatggaatggg

SEQ ID NO: 1434 - DNA, 203 bp, Homo sapiens
  misc_feature (98)..(98): n is a, c, g, or t
  misc_feature (165)..(165): n is a, c, g, or t
taaaccgccgcttatttacgccacagcgcgccgtcacactgtatctatattttgtattccccccgtcgcgactcgtatcttatcatacccaaaattancgcgcccgccccagcagctagacacaaccacgacatcgtatatatggggcgctatattagtgacatnctaacagctcgcgagttcggtgcgtcgccgccgggaag

SEQ ID NO: 1435 - DNA, 253 bp, Homo sapiens
agagctgtgctgactatgttacatcctaaaaaaactatataaagcaatggataatgtcgtttatgaattaaggtgggaaaatcgggttggaattgtgtcaatggacaaaggccggaggggcgaaattaagtcactactctgacacctcggatttgggagaaaatatgccgctgcaatagatggtattggaggaaaagatgtttgtgaacaataagggatacggaaagatagcgccaacatcaggagcaacgtg

SEQ ID NO: 1436 - DNA, 299 bp, Homo sapiens
atcctgctgcaacaagccaagccttcctgcgcctgaactcacagcacactcaggacaccaccttgcctcatgggctgtgggtgcatgcccatctacaccttcacagacaggctcacgggtagggtcaggctgcacatctctctagccctgccgtgcagtgggtgtggcagccccagcagggtccagagcaggaatgcagctggatagtcgggaggggggagctggggtatcttcaggcaagtcggaatcacagaatcacatgttaaagtccaccaagcccttagagagacctaccatca

SEQ ID NO: 1437 - DNA, 288 bp, Homo sapiens
  misc_feature (212)..(245): n is a, c, g, or t
gaatgaccaacaatttggctttcctagaaagagaagagaatatctgaattccctgtaaactggtaaatcctctaccatcagtcctgaattctgagggggcctgatatttaagcaacaaaacttagaaggttccacctgttattcctagctctgtcactaaaaatcgtgtccaaacagaggtaatacgaatgtgttacccgttcccgaaattnnnnnnnnnnnnnnnnnnnnnnnnnnnnnnnnnncccagagcacagaatggatccagtgtagtagtgcaggtgacca

SEQ ID NO: 1438 - DNA, 252 bp, Homo sapiens
gatacagtttgtgccatcagggaacacacacactgtttggcaatataaactgtatacacctgcagaagagggatgaaagcaccttttccgtatgtatatgattgcctttaccatgtcgtaatgaggtttgtgatttaattttctatttctcccaacatcgagaactcctccatggcgaggattatttctcacatcctctagccctagcacactgactggaaaataactgatgctcagggagtgtttgtgaat

SEQ ID NO: 1439 - DNA, 119 bp, Homo sapiens
aagaatagactagggcctcagtcttacacttcttgaccacacctgaatcttaaaggcatttgaagtctacatcctacgttaaaaggttctacttgccagcattttagggcgttaaacaa

SEQ ID NO: 1440 - DNA, 245 bp, Homo sapiens
  misc_feature (217)..(217): n is a, c, g, or t
aaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaaatgctcaccattggaagtgaatggagccacccaatcaactggggggagcaatacttncaaaagagaatccttttcctggttgcat

SEQ ID NO: 1441 - DNA, 265 bp, Homo sapiens
tggcaccatgaggattacagacagtggaatcttactgtcatctggacagctgttttcctgtttggatggtaaaggaagttgagagtctttagacctgtgcacagccccacaccaaggggtgctgtatgctctaggcatcccctcccccaggggattttctaagtagatggggggacacggtgaactggctgtgtccatctttgtcactgagtgaaatctctgttttctattctctgagaagataagtttgtatgttctgagaata

SEQ ID NO: 1442 - DNA, 296 bp, Homo sapiens
ttgcctgccaacacaaggccgcagtccccatttgatcacagccacacgagcaagaataacaggaaatccaaaggcagaaacaacaattccagtagtgaagaaatatgccagttcccgacaggcactactggttgcatctgagtcataggtgactcttttggcaatgaaatgggggatgggggagatggcgtggaaaatcaggacgaataagggccagtaaacgccataatcctctaaggcacatcccagcataagaaaagtcagtccaatagccccactgaaggataatggcccga

SEQ ID NO: 1443 - DNA, 294 bp, Homo sapiens
ggaaccgcatcttcacagtcctggtcagctggggcgtgcagcatcggccgtccacgcaggaaccgcagtacttgggccggtatttcttcacactcaaacatccagcgtaagtaaacctgactgggttcgggggatatcttggtacttgctgcatttcttgcccttctgtaagagaaaggcgagaaggcaagttaggggtgatatttctctttcttcaaaaagatgttcacatcccaaccacctgccaggcaacagtctacacgtcccttaaggaacttactttcaggctgctgt

SEQ ID NO: 1444 - DNA, 76 bp, Homo sapiens
gggtgtaatgggagcatccagccactcggcgggcagcatggagctataaactagccatcccttttaggggttctgc

SEQ ID NO: 1445 - DNA, 177 bp, Homo sapiens
  misc_feature (59)..(71): n is a, c, g, or t
gaagtaagcctcatcatcagagcctttcctcaaaactggagtcccaaatgtcatcaggnnnnnnnnnnnnncagccactaagaacccctctgcttttaactctagaatttgggcttggaccagatctaacatcttgaatactctgccctctagagccttcagccttaatggaaggtt

SEQ ID NO: 1446 - DNA, 257 bp, Homo sapiens
tttctgctgctccagatagagccaggcagagcagcaggcaccagccctcctgtgtgcccatggaggctgctctcgagttccctccttgcccaccgcccgttctccacagtcctacgctgcttgcgaggcccggcggaagaagggggctctccaagcacacactggcagcctgcagcctttaggtttcttcccctgttccctgctgcatcctcgggatttcgcgcaccccattaatctattctcggagtcgggtgggt

SEQ ID NO: 1447 - DNA, 32 bp, Homo sapiens
aatatcgaatagtgcaaattgtataattacaa

SEQ ID NO: 1448 - DNA, 116 bp, Homo sapiens
acagcgtatatttctaatcatattttttaaagccaagagaactggttgaatgaatgtttattttcctgaaggtatttttaagataaagcttcctaatggcgtgtaaactttgcata

SEQ ID NO: 1449 - DNA, 268 bp, Homo sapiens
atttgtctggcaaaattaagttcttttttctttaaaatgaactttttttcttatttcgaagtgatgtgtatgtaaagaggcagtgtagactggtggttaggagcactctggagtcagaagcctgcttcagaatcttggctacctcacttaccaaggatagagctgtggggagtttacttgttctcactctctcttcttttttccatctgtaaaatggcaaaaataaaccacctaagtaaaatggcctctgcgagagacccataaatta

SEQ ID NO: 1450 - DNA, 180 bp, Homo sapiens
cagtgtagccagtgtgctcggcgtctgaacgtctcaaagtggccacagctgacaatgacagctgacaagggagaagaaaaggagtagctcggagaggaggaaggagaagtcccgggatgctgcgcggtgccggcggagcaaggagacggaggtgttctatgagctggcccatgagctgcc

SEQ ID NO: 1451 - DNA, 217 bp, Homo sapiens
cagtgtagccagtgtgctcggcgtctgaacgtctcaaagtggccacagctgacaatgacagctgacaagggagaagaaaaggagtagctcggagaggaggaaggagaagtcccgggatgctgcgcggtgccggcggagcaaggagacggaggtgttctatgagctggcccatgagctgcctctgccccacagtgtgagctcccatctggacatagtg

SEQ ID NO: 1452 - DNA, 261 bp, Homo sapiens
tgaggagggacagacagctcttcctttcggagcctggctagtctaggacatcaccttgctgtgtcttctcaagcttttaaaattgaccctgaacgtgtgacagggtcctatggtgttactcaaagctgtgcagggtaaatgatgacatatttattctttttccatttgttctagaaacagtgcctttttcatcagttgcattttccaggctgagagctgtataaaacattttggactgtgaccatgtaccttcctttttaa

SEQ ID NO: 1453 - DNA, 230 bp, Homo sapiens
gatgatcacagatgtttcccaaaatctaggaactacttcaattcatcatcagcatatggctctgaaagaaatccattttaaaaaatcttacatgattcagtactgtcatttctagttctaagcttctatgtgttgagcctagctgattgagatgggttcacaaagggtaaatttcattcatgagtatttaaatgtttctgaggaaacatggatcatttcaataggactag

SEQ ID NO: 1454 - DNA, 226 bp, Homo sapiens
tgtgaatgcaagtgcggcccatcgacctcctgttcgtgctggacagctcagagagcattggctgcagaacttcgagattgccaaggacttcgtcgtcaaggtcatcgaccggctgagccggcgacgaagctggctcaagctcgagccaggccaagtcgtacgcgggctgtagctgcagtacagccacagccaagatgcaggagcatgtgagcctgcggcagcccca

SEQ ID NO: 1455 - DNA, 216 bp, Homo sapiens
aaagcagtgctgaatacttgaaactgtgtgctctgttctacttaatgttctgtcagaatgttcttttgtaggcagtatgtcatgatgtaatcatctatctccttgtctgtttccaagttacactgtgaagtctgcgacccttttgaggtggtcatcaaagacacagattccttgtttaaccaagtgtcccaaagcatgtacctgaagttatatcat

SEQ ID NO: 1456 - DNA, 190 bp, Homo sapiens
aagcacttcagtgaccaatgacaagttaacatccaaaatgaatgcggaagaagactcagaagagatgcccagcctcctcactagcactgtgcaagtggccagtgacaacctgatcccccaaataagagataaagaagaccctcaagagatgccccactctcccttgggctctatgccagagataagagat

SEQ ID NO: 1457 - DNA, 243 bp, Homo sapiens
gaaaactgtactttgtaccctcacatacaaagggatcaaatttgacctggtgttattttagccccaaatttatgacattacacaatattaaaatgtaaatgtttctttacccaaactacttctagatattctagtatttgcttctggtggaattaaatgacggtaaaattggctaattatttgaatgaatgaatggatggatgttttgcatgctcactttctaggtcctttgtctagaaagga

SEQ ID NO: 1458 - DNA, 66 bp, Homo sapiens
tgggatcagcatcgaattcctttcacctcctggaaatccatcaagccaggtgtacatttgaaaacc

SEQ ID NO: 1459 - DNA, 155 bp, Homo sapiens
agatatatctgtgaccgcttctaccccaatgacttgtgggtggttgtgttccagtttcagcacatcatggttggccttatcctgcctggtattgtcatcctgtcctgctattgcattatcatctccaagctgtcacactccaagggccaccagaa

SEQ ID NO: 1460 - DNA, 299 bp, Homo sapiens
cttcgagggagtactttaagatgactccactcagcctcaaggtcactccctgcacatgtcctcagttccctgaggctagggacagcccactagtccctcacagatgagtcctgctcagagtaggcagcccctcacaaggctgagggcctggaggaggctgaatactggggcctctgggtgccactccaatccggaagagcagccgaccagcatctcaccttccagacacggcgtcctggctgagctctgcccgcctggaggctcccacaggatggccatggatttttagctgccatctc

SEQ ID NO: 1461 - DNA, 279 bp, Homo sapiens
aagattagattcctgcctcgggccaggtgaaaggaaggcaggaaagagattctgtttcctgacccaacattatcacaaaagactgtaacaagggctgtgggagttatggaccaggaacctggttgaaaaccattataaatcataacaccacaaggacctatattttgctttttaggacattgtagtaggtgggtagttttcatcctcttgctttttaaaatctatcttgcccagaagtttattgggcatttctatggaaacacaacacctctcttaaat

SEQ ID NO: 1462 - DNA, 185 bp, Homo sapiens
gcgaggttgagctgtcatgaactctggagatgtgtcaactgacaacaccagactgactttggctttgacgaagtctgaatagaattggttccaaatgcccactgcctccgtctcctgtggggtgtggcaggacgtctcacagtgagcacacgccatttgggagctcatggtatgtggtcggtttg

SEQ ID NO: 1463 - DNA, 88 bp, Homo sapiens
attattttaatcatcttcagtgcactccactggctcaatcgtccttccaaggatgatttcaaacctcctggcaaactggaacgggaga

SEQ ID NO: 1464 - DNA, 173 bp, Homo sapiens
gaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaa

SEQ ID NO: 1465 - DNA, 294 bp, Homo sapiens
tattatcattgaacttcggtaaagcattaattgtggcatctttgtcagatgtttagataagatggttgccgtacgcatagtctgcatgttgtatttttagtctttgaagatatgaagtcaggtaagcaacatcctaacatagtctatttcttgacatctcttacaaacgtagagtatagcctatcctcaggtgtgtgctgaagtttatattagggcttttgggtaccttagaatgtgggtattgcagtctttattcaggatgttatcagtcactggtacagttagtcttgttat

SEQ ID NO: 1466 - DNA, 271 bp, Homo sapiens
tttatgttcatagtacttttcctcttgtctactccagacagttattccataaagcatttgtataattaaaaggaaaacagaaaaaggaaaagtaggcaaatgtgaaaatagtttcaatatatcttatgatttcttaatgtaaaatgttttgttgaagtatatggctatcatgactaagtgctagaatttatagttacaggcggtgtccttttaaatgtggaaaggcttttaaaatattttaaaactggacctgtattatcctgaatacact

SEQ ID NO: 1467 - DNA, 45 bp, Homo sapiens
tgagagccgagtgaccgttcctgcaaaagtttacccaggccaatt

SEQ ID NO: 1468 - DNA, 214 bp, Homo sapiens
gaatatccccttctgactcatagtccaaacttgtgaagtcaaagttttcctccagcaaacaggagttggcagtgggagacacgggggccatgctgtctcgtttccgaatgatctcctctcgcaaacctttcagccagtccttggtcttcggtctaatcttcactgctctgcctttcaccttcataccgtccacgtccaggacactgagagccga

SEQ ID NO: 1469 - DNA, 252 bp, Homo sapiens
ttcatcagccatggcggctggcaacgccgaggacagagcgccagctctagaggcgtggggcctcattctgggcctgggaccctgcgagggacggtcacatgtccagcccagctcccggctggcagtagacggtgactccacggcgacagaacctgcatccacccgcgcctgtcgggtccggggagcggccctggaggatcactcctcagtaggtgatcttccagtgggtgggttgctcacacgccttctctt

SEQ ID NO: 1470 - DNA, 142 bp, Homo sapiens
agcctatgctgctcctgttcttttgccaaatctacccaaggcctgaggtggaggaatgctactttccccacaaatggtgggtcccactcctggccccagacctgaaggctgcagagttggaaacccaaggtccaaggagaga

SEQ ID NO: 1471 - DNA, 268 bp, Homo sapiens
gattcatttcacacttctgcaactactcaggcaaccagacaagaaagcagcaccacatttgtttctgatgggtccctggaaaaacatcctgaggtgccaagcgctaaagctgttactgctgatggattcccaacagtttcagtgatgctgcctcttcattacagagcagaacaaaagctcccctgatccaactagcacactctcaaatacagtgtcatatgagaggtccacagacggtagtttccaagaccgtttcagggaattcgag

SEQ ID NO: 1472 - DNA, 170 bp, Homo sapiens
ttccacaaactatgtcatcaggctcatttttcaaaaccaatgtgcacaacacctggtcaaacttctgcgtcaactacattccgtgtcaataaaatgtttgctttgccaagggagactctgagaaagtgaccaatatgtagcaactgagaagtcatttaaaggacatcaga

SEQ ID NO: 1473 - DNA, 266 bp, Homo sapiens
tgaaggacttcctgttaaaaatggaacaagatacattgcagtgtcatttatagatccctaagttatttacttttcattgaattgaaatttattttggatgaatgactggcatgaacacgtctttgaagttgtggctgagaagatgagaggaatatttaaataacatcaacagaacaacttcactttgggccaaacatttgaaaaactttttataaaaaattgtttgatatttcttaatgtctgctctgagccttaaaacacagatt

SEQ ID NO: 1474 - DNA, 267 bp, Homo sapiens
acaagtttctctgggatgtcgcttttctcgacctgcttatccgtatttcaatccttggaactgcctagtccccatgactgtgtgcccaccgagctcctgagtgttctcattcctttacccacttctgcatagtagcccttgtgctgagactcagattctgcacctgagttcatctctactgagaccatctcttcctttcttttcccttcttttacttagaatgcctttgaattcatttgcctagggcttccatagccaagcatcata

SEQ ID NO: 1475 - DNA, 241 bp, Homo sapiens
caagcaattgcaaaaaactcttttaccacctgtgacaatatcccattttatctgcataactttggcatcttacgtcactgtcttgtacagtctatgccaacagtttcagttttttctctccttttggggcgaggggaaatttcatgtggtcaaatggcattacaaaattactgaaaagtcactttactttccctaaaatcttccaacagagaacatgtcaactgtcaataagcacatacac

SEQ ID NO: 1476 - DNA, 269 bp, Homo sapiens
catatcaaatggtttctaacaggtattggtttgcctaattttcaaaacaaacctccttgatccacgggggcccttttgatgaattacaatgggggaacctccatttcccctttacccgacggcggaacaccacaattcttttttccccaagcggggttgctctctctttaccaagcaatcctttggttacccaatcaccgtgtgcgccttgtgtggtaacactttttcaacgcgccctcatgcggagacgaaatcgcactctctttgcg

SEQ ID NO: 1477 - DNA, 239 bp, Homo sapiens
aaatcttaaaggcagaccacgcaaaaagaaaccatgcccacaaagaagagattcattcagtggtgttaaggattccaacaacaattccgatggcaaagccgttgccaaggtgaaatgtgaggccaggtcagccttgaccaagccgaagaataaccataactgtaaaaaagtctcaaatgaagaaaaaccaaaggttgccattggtgaagagtgcagggcagatgaacaagccttcttgg

SEQ ID NO: 1478 - DNA, 185 bp, Homo sapiens
gacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgcacacaggagcgcatggccatggctt

SEQ ID NO: 1479 - DNA, 189 bp, Homo sapiens
aagcttccagaagaacagtcatttgatgggtttgctcaggctccgcctacagctcaactccctgccactggccagcccactgttaacaacgactattcctattaccacatttctgaagcacaaaatgtctccagtcatgttccataccctgtagcgttacatgtaaatatagtcaatgtccctcagcca

SEQ ID NO: 1480 - DNA, 278 bp, Homo sapiens
  misc_feature (247)..(247): n is a, c, g, or t
gaaatacttgcctaagtttccctgatgctttctccccaagctccacggcctttttacattcttctaacaggtcccggacacacccatgcttgtctggatatagtgttatttcctaagtaatgaaaagataaaataagtgctttcaagaaagcataaaaggtctgctaccacaaaggaagagaggagaaagttgcatcattgttctcaactgtccccagctggcccccatgttcttgctctcattccncaccccaactccctcatctgtgaattcactc

SEQ ID NO: 1481 - DNA, 279 bp, Homo sapiens
ggagaatacagcttttggcctactttggtgaaaatggatttaatcctgatttttgtaagaaacacccagatgtttcttgtgataattgctgtaaaacaaaggattataaaacaagagatgtgactgacgatgtgaaaagtattgtaagatttgttcaagaacatagttcatcacaaggaatgagaaacataaaacatgtaggtccttctggaagatttactatgaatatgctggtcgacattttcttggggagtaagagtgcaaaaatccagtcaggta

SEQ ID NO: 1482 - DNA, 163 bp, Homo sapiens
gaaatctacaaaatcactgccactgacttttaccctcttcaggaagagggccaaggaggaggaacgcctcatagctttgaagaaaatcctcagctcgggggtgttctatttctcatggccaaacgatgggtctcgctttgacctgactgtccgcacgcagaag

SEQ ID NO: 1483 - DNA, 259 bp, Homo sapiens
ataaaaacctccttgttcgctgcagccccggggggtgtaagggggaaattggcggccctgggccatacggaaaacaaggcgccgtgacactccaacagaagatcggcaccgtcccatccacacggctgcaaacttgcgccaaaatgcatctaaaccacgagaacgcccgggggggatccaccccgcgtgggcacgccgcggggagagagggcgaacgccgaaacccaggtgtggcgagcaaagctaccccataaaacct

SEQ ID NO: 1484 - DNA, 249 bp, Homo sapiens
gacagacacactgggagtcgtgctgcgcaccccccctattattttcgcgcacccaatttaaagaggtgggccggccgcgcccacccgtccatcacctcgatatgcacactacctccgccgtcggggccctcgcggcccgccatgctgttcgcaaacactcaccgcccggccgcgggtccgcgatgctgcgcgtgtgtgagaagtatggtgagcgcgatatggcggcaacaccactgtcgacttgtctcg

SEQ ID NO: 1485 - DNA, 175 bp, Homo sapiens
aacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaa

SEQ ID NO: 1486 - DNA, 191 bp, Homo sapiens
gaggagctgcagatggaacccgtgtgaggtgtcttctgggacctgccggcctcccgggccagctgccccacccctgcccatgcctgtcctgcacggctctgctgctcgggcccacagcgccgtcccatcacaagcccggggagggatcccgcctttgaaaataaagctgttatgggtgtcattcaggaaaa

SEQ ID NO: 1487 - DNA, 248 bp, Homo sapiens
  misc_feature (70)..(141): n is a, c, g, or t
ctagtgctgtcatgttggaggtgtctgacctttgcactaagtttccccacttacactaaatggggataannnnnnnnnnnnnnnnnnnnnnnnnnnnnnnnnnnnnnnnnnnnnnnnnnnnnnnnnnnnnnnnnnnnnnnntaatgcagaactactcactgctgctggagtgcgctgttatattctttattaggtcctcagactttttctatgcctaagcttgagggtctctctcagctgtgtttttc

SEQ ID NO: 1488 - DNA, 296 bp, Homo sapiens
accttgtgggcagacgacaggctgtagtcctggtactgggtggcgtagcacagtggcgggaacctgctcttgctgttctccccggaactgatggcagatggaggctgtggcaccggcagatgtctcaggggatggcccaggcccctcatggggtatcgggtgaacttatcattgggtacatttgcgctcagtggcttgtccggcatcaaagggcagctcccacgcctgaggttcttcatccgtttccacatcaaatgtgaggtgctgccaccaagttgggtctcccgcatacgcaa

SEQ ID NO: 1489 - DNA, 247 bp, Homo sapiens
gcttctgggtggccaaaccagttacccaatctgctggagacccaaaagaagatgaactctatgaagcagccataatagaaactaactgcatttaccgtctcatggatgacaaacttgttcctgatgacgactactgggggaaaattccgaagtgctcccttctgcaacccaaagaggtactggtgtatgattttggtagtgaagtttacgtatggcatgggaaagaagtcacattagcacaacgaaa

SEQ ID NO: 1490 - DNA, 238 bp, Homo sapiens
agtacaatgaacagcacgtcccaggcagccccttcactgctcgggtcacaggtgacgactccatgcgtatgtcccacctaaaggtcggctctgctgccgacatccccatcaacatctcagagacggatctcagcctgctcgtacggccactgtggtcccgccctcgggccgcgaggagccctgtctgctgaagcggctgcgcaatggccacgtgcgcattgcattcgtgcccaaggag

SEQ ID NO: 1491 - DNA, 242 bp, Homo sapiens
agaattcaccaccatcgagaaccagccctggtttgcggccatctacaggaggcaccgggggggctctgtcacctacgtgtgtggaggcagcctcatcagcccttgctgggtgatcagcgccacacactgcttcattgattacccaaagaaggaggactacatcgtctacctgggtcgctcaaggcttaactccaacacgcaaggggagatgaagtttgaggtggaaaacctcatcctacaca

SEQ ID NO: 1492 - DNA, 287 bp, Homo sapiens
gcttacagcggcgatacagctcatagtgccgggtgtgggtctgctcccgcagatcctccatgttgacccgaatcagcatctcccgcagcttcacaaagtcgcagtgggcctcgttttcaacctgcacagtgccccaaggatactgccgcgccctcatcatcttgttgcctatcttcagttcttctgtgctgccaatgacagcaaacggcaggtgggcgttcatggttccattgatctctgccaccgactcatcatctgtaaggaaactgatagatctggactccgtt

SEQ ID NO: 1493 - DNA, 192 bp, Homo sapiens
atttgggactctgccatattctttccgtctatttaaaaggattggattatgaaaataaagactggtgtcctgaactagaagaacttcattaccaagcagcatggaggaatatgcagtgggaccattgcacttccgtcagcaaagaagtagaaggaaccagttaccatgaatcattgtacaatgctctacaat

SEQ ID NO: 1494 - DNA, 177 bp, Homo sapiens
tcaaagatagaatcccatttttaatgaactgaagtagcaaaatcatctttttcattctttaggaaatagctattgccaaagtgaaggtgtagataatacctagtcttgttacataaaggggatgtggtttgcagaagaattttctttataaaattgaagttttaagggacgtcagtg

SEQ ID NO: 1495 - DNA, 225 bp, Homo sapiens
tgaagataacatggccttgcccagtgaaagtgtgtccagcttaacagatctaaagccccccacagggtcaaaccaggccagccctgccaggagagcttctgccattctgccaggagttctgggtagtgagaccctcagtaacgaagtattccaggagtcagaggaagagaagcagcctgaggtccctagctcgttggccaaaggagaaagcctttctctccctgg

SEQ ID NO: 1496 - DNA, 257 bp, Homo sapiens
ggttgtaaagcctcattgtagacaaggcctgagcatccacagagaagatacaatgtttatatgaatcctggtgtgcccaagtgtgatctactctcttcactgactactctgagtgctgatgagaatatatatattatcctctgactggcttgaatagctaagacaatacagaaaggtaacagagtggtttcacaccctcatgtgcttctgaaataaaaccatgggctcattagtgggtagctcactatctgtggcaa

SEQ ID NO: 1497 - DNA, 242 bp, Homo sapiens
  misc_feature (45)..(45): n is a, c, g, or t
  misc_feature (52)..(52): n is a, c, g, or t
  misc_feature (121)..(121): n is a, c, g, or t
  misc_feature (165)..(165): n is a, c, g, or t
  misc_feature (168)..(168): n is a, c, g, or t
ggttgctatgcgaaagcaagactgtgggttcattccattttcctnatatcgngatcatcaccatctgtgtatgtgtgaatgaaggttttggggatgtccttttgccctgaccctgaactgncagattgacaaacccagcagacccatagggtattgatctgcagnaantccttggggtggaaagaaactggtttcatcttcgggaatgccaaaccattttatagcatggagcccctacctgt

SEQ ID NO: 1498 - DNA, 207 bp, Homo sapiens
  misc_feature (115)..(115): n is a, c, g, or t
ttcatttttcttcccctctgctagtttggaagttatattataccaagttttttagtattagcctagaaatcttaacataaagacttctaataagcaatatctttaattttttttncctacccaatactagatcatgagcattttcccacatcataaagaattggtcacaagtcagccccaaacatagtccagtggaatccaatgata

SEQ ID NO: 1499 - DNA, 241 bp, Homo sapiens
aatcctgggaaagaaatcgctgtgcagtgttctcccagaaaccaggcttctgcttgaaagagcaaagtttaaaagtctagtcacaagtagcccatatctggtctacttcaaaaagtttccatttatactaccaccttaaaaatttcctcaagcataaaacatgtttataaagttacaaatttgaatgtaactaaagatacatagacattttattattacactttcatgtactgcttgataa

SEQ ID NO: 1500 - skipped

SEQ ID NO: 1501 - DNA, 191 bp, Homo sapiens
gatgttccacatcattactggccccaatatgggaggtgaatcaacatatattcgacaaactggggtgaaagtactcctggcccaaattgggtgttttgtgccctgtggagtcagcaaaagtgtcccatgtgggactgcatcttaaccccaatagggggctggtgaccattcaattggaaagggatcctccc

SEQ ID NO: 1502 - DNA, 82 bp, Homo sapiens
ccgggaccactgcaaactgtccgtatccctttccctccccacagaaaaaccccgcgcccaaaaatcggccctgtgctgtccc

SEQ ID NO: 1503 - DNA, 269 bp, Homo sapiens
gacacaccaacacagtgaaatacagtacttgagaattcatgcaccaggtcagaaagttgtaaagttaacatcgagttttaacaaacccttctgtatatgccctgataaacaagtgaacttaagagcttctagctagtaaataaataagtcagtcctgtggcaaatattacaagtgttgaatcacttactagaagaatacttaattccgaaactcggttgggctggttttatttttttatcatgtggagttgccaaacattaaaccagaa

SEQ ID NO: 1504 - DNA, 275 bp, Homo sapiens
  misc_feature (59)..(97): n is a, c, g, or t
  misc_feature (100)..(128): n is a, c, g, or t
gtgtgttggattaattaggatcatccctttggttaataaataaatgtgtttgtgctaannnnnnnnnnnnnnnnnnnnnnnnnnnnnnnnnnnnnnnccnnnnnnnnnnnnnnnnnnnnnnnnnnnnnaatatgttcgggccgcctcgggcccttcaaaaaactttttcaagaaccatttcgttttggcccccgcgggccccaatagggtaaagtgaaaacttggcccataccttgttttcccataggaaaatcccctgggccattgaacaaagg

SEQ ID NO: 1505 - DNA, 279 bp, Homo sapiens
gtgtgggggctgactaaagtttacaattccaactaaaaatcaccctgcttctggcttatctgaatcccttacccaccccaccccaccaccctactcctatttattcagcaccacactacccaggaaatacactagcaaattgtgcaatggaataaaatccacactttagattcttgcaactgtatcatatgtaatagtatcactttttctacattttggcgcaaataaatttttacataaactacgggaggccaagggagctcgatataaaaaacatgt

SEQ ID NO: 1506 - DNA, 259 bp, Homo sapiens
tgcttttctgctcaatactggacagcaccctccaggcagccctctggccgcccaccacgttcttataggctactgagagcaggtttcgctcttcgcaggagagctcctcgcccttctccacggcgcctttcatgaaggctgccatgtcctcatagcgttcggcctgctctgccagcttggccttctggatcagactggctctctccatggctctggggacacacagcgggcggcgggctaactgctgcctggcctcgtg

SEQ ID NO: 1507 - DNA, 281 bp, Homo sapiens
tccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgc

SEQ ID NO: 1508 - DNA, 286 bp, Homo sapiens
aaaaacatcttcagtgctccggtgacaacgtggatgtcctcccactggctgtcgtccaaattcagcttctcttcagtttaatgaagtgacaaattattggcttgctctggaggtcaaatgaccactgtgaaaaatctgcagcttactaggggtgtccacaggtctccatccagttctgatagaagggctggtattccagaaacgacttggttgacaataaatcttaacttctgtattgttgccagattgccactaactcgatatattccatcaacatctagacctc

SEQ ID NO: 1509 - DNA, 244 bp, Homo sapiens
cggcccttgcgcctttctagcataaagtggtgtgtcagagccactgtctccacagaaagcaccacgtttgtttcatttgacttatttgaacccgtttctcctgcctttgcctttttaaataaaaatagcaaaaattgattcaagtgaatctattagaattttctaaaatggagcccatttgtcttttcagtcttgcaagtaaagtctttaaaacaattaagcctcccaatgatttaaccgtatt

SEQ ID NO: 1510 - DNA, 295 bp, Homo sapiens
tggtacaagagacaatcccggcattggacatggagttcgggctgatctgtcctacctgaacaccgcttccgttcctgggctgtcgtcttcaccgcctggttttccatggaaaggaagcctccccagtggccttttgaaaaggcactgtggcgtggtccgataagtctctgcagaggcaccagggatgctttcaggacacagcacccagaacggaggctcgatggtttaaagtttggctctgcatacaccttagggtcgctgacacaatatctggacacgacgtcagacatgatat

SEQ ID NO: 1511 - DNA, 103 bp, Homo sapiens
ccgagctgacgagtcatagatgcataattgcaagatataaccagtaggagagagagaatacacaaggagtataaccaccatcggcggtgctctctcaaaagga

SEQ ID NO: 1512 - DNA, 174 bp, Homo sapiens
aaggtgcagcaccatagacacatcggtttcggctgttaaaagatggatcgttttaaaaactgtgttttccttccttaatttttggtcagtgaagctagcacttgtttgctgaactgtggaagaactgcaaggtcacacacattattcatgataaagcaaccgagctgacgagtc

SEQ ID NO: 1513 - DNA, 294 bp, Homo sapiens
aacccagactacaaggcaatataaaactttttttcaatagtcttttgcactaatttttttggcataattaaaagttgtacacatttttcaactgttttaccatctaagttaccaaaacacaaaatggccaatgtaattatccgcctaccaaagtcctgattttcagtacttcaaaataaaactcatttcaaaatgtcaataaaaacagcactacccatttaaaagagacagaaatagtccttttcctagttagtctatgtaaatctaagaaacatttgtcatcagctatcaaaa

SEQ ID NO: 1514 - skipped

SEQ ID NO: 1515 - DNA, 283 bp, Homo sapiens
gatggtcagcccgtgggagccactaccctgccagttgggcagcagcagctcccgggttgtctcctccttctccatctttgcaggattccgctcaggagcgaatgccttgccaggagcccgcccctccttcctctcttcccctcagtctctctcgtcgggaatctcggtcacaacctgagggctcagccccagggcacggccatagccggcgcgaggcccaaggctgcggtgctgcggctactggcggcgacgagccccgttccgggcgggtctggcagagagg

SEQ ID NO: 1516 - DNA, 274 bp, Homo sapiens
tgaaaagcatacacccaagttttacttttgaaatcctaaggtcttggttttgaaaaccccaggcgctaaggaaattacatgttttaaaatcctaaaggttggggaattaatattctaaacttcaaatttgtgaataatcatgacgttatgggcaaatacatataaataaacatataaccagaacacgtctttcccctttatccaatggaaatacgatcaagcatcactcttagcagaagataccagacacttgtagggacacgaaaagcgatat

SEQ ID NO: 1517 - DNA, 152 bp, Homo sapiens
ttgggaaccacttcgggtgttgcgataacacccctccacccacgtggggcataaccctggggctacatgccaacccccagtggaaacacttctcgaacgtttccggggagacacattacatcagagaaagcccctactgtcgcggtgtgagg

SEQ ID NO: 1518 - DNA, 230 bp, Homo sapiens
cggagctccccgaagtggcgttttgggaaccacttcgggtgttgcgataacacccctccacccacgtggggcataaccctggggctacatgccaacccccagtggaaacacttctcgaacgtttccggggagacacattacatcagagaaagcccctactgtcgcggtgtgagggccccccccaccgtaaaaatctttttggtgggggcgtggtgggacctctataatca

SEQ ID NO: 1519 - DNA, 213 bp, Homo sapiens
  misc_feature (66)..(66): n is a, c, g, or t
ctgattatcaggttttggctgggttttgttaactgctgagctctttgaacaaataaaatatttggnctacaagtgctctgattatgaggtgggtgaacctgtagccttgccagtcaccctcctttaccaccttaacaggtcctcactatttaaaaatcactgttttgagttccctgttaggagactcagattctcccaataaggcattgctat

SEQ ID NO: 1520 - DNA, 80 bp, Homo sapiens
ttattgctccgcatactgagaatctaggccaccccaacctctgttccccacccagttcttcatttggaggaatcacccca

SEQ ID NO: 1521 - DNA, 227 bp, Homo sapiens
ggcacgagaatgtactctcctggcggcagcttgaagcggttgagcacctcccggaggttgatgaaggtgtctgagcgctccctggcgcgattcgtcaggaagaagtttttgctgaggtggatgttggtctgcccacttaactcctctggaacctcatagatgccaaagccgatggtgtgcatgtcctcgcccatcttcctctgccgccgtcggtgcttctgaatgag

SEQ ID NO: 1522 - DNA, 271 bp, Homo sapiens
ctccgcactgcaactgctaaagtttctggaacacgatgctcctgaattcatgatgcagctctttgctccacaggaacaatctctcccatcatcgtgattcattccaagattatgacccaattcatgagcaacaatggaagcaaatgtctccacagtgatttgtccaaacacattaatcccgcctgcgtggctccttgaacacactgttcccacaaatgccattcctgcagttccaccccgacctttctttagaactagctgtgtactgtca

SEQ ID NO: 1523 - DNA, 280 bp, Homo sapiens
cagtattacacagtgggaggtccaaattggattagactttggcattgaattccaaagtattggtaagtctagcacatactataaaggctttgctaaattctggtgggtacattatttttaaaacctgtctgtctgtcggtatcacacagaggtcacttcttgagtaaaataagatgaccttaagaattcacataattcttgaagaagaatataagtcacgatgcttccacatgaggccgcgtcacaccaccatcgtttggaaatccagcacctcagccgt

SEQ ID NO: 1524 - DNA, 268 bp, Homo sapiens
agagttcctagattacctcactgggaatagcattgtgcgtgtccggaaaagggctccatttggttccagcccactcccctctgcaagtgccgcagcttccctcagagcatactctccagtggatccaagtactctctctcctaaagacaccaccttcctgccagctgtttgcccttaggccagtacacagaattaaagtgggggagatggcagacgctttctgggacctgcccaagatatgtattctctgacactcttatttggtcat

SEQ ID NO: 1525 - DNA, 294 bp, Homo sapiens
cataatagttccaagctaaaaacaacccaaatgtctgtcagcagtgcaatgtataaataaatggtggcatattcataaagtgaaatattgtactgcaaataaatgaaagaaccattgctttatacaataacatgaatgaatttcgcaaacacaatcttaagggagagaaaccagatgcaagagagtatgtatatatacatttatataaattatgtaagtttcagaaacaggcaaaactaatcaatgatattagaaatcagcatattatttacttgaagaggatttgggcaactt

SEQ ID NO: 1526 - skipped

SEQ ID NO: 1527 - DNA, 152 bp, Homo sapiens
aaacagcattgctttctgaaattagggcccaattaataatcagcaagaatttgatcgttccagttcccacttggaggcctttcatccctcgggtgtgctatggatggcttctaacaaaaactacacatatgtattcctgatcgccaaccttt

SEQ ID NO: 1528 - DNA, 279 bp, Homo sapiens
gggtgtggctatgctctaataacattttgtttatggacactgaaatctgaatttcatagaattttcaggtgtcatgaaatattgttcttcttttgattttctgcccaatcatttgaaaacatataaaccattcttagctcacaggttgtataaaaacaggtggcaggccaggtttgattcgtgggccatagtttgccaacccctgatctaatggtccttttctagtccatgttgtaaaatgtatatatttttaaaatcccgttacatatggctacttta

SEQ ID NO: 1529 - DNA, 249 bp, Homo sapiens
gatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggttaaaa

SEQ ID NO: 1530 - DNA, 246 bp, Homo sapiens
gatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaactggtta

SEQ ID NO: 1531 - DNA, 275 bp, Homo sapiens
tgggcttccggtctgagtctaccatgtgtgtcatacccaggagctggctgctcttcgtgccgcagggcggatgctctaggtgcctgttcgtaacgtggtctgctgtcgtaagacagaggggctggctcttcaaaacgtggaaagtaccctcgttctgaggactcttcgggatgctgtctggagtcaaggtcttgagagtgctgattatcaaaaggtggccgagatgggtagggctgtttgtcatcataatatgaccactgttcttcatacatggg

SEQ ID NO: 1532 - DNA, 144 bp, Homo sapiens
tcatatagcatcttggttagtttttccttatctctatgtacatatctatctacttctgactgtagatgggtatatagatagatgccaaagcttcttatggttctgggggtagtatgcatcatttattggggtctctgcctttaa

SEQ ID NO: 1533 - DNA, 180 bp, Homo sapiens
gtcaggataacgtcatatagcatcttggttagtttttccttatctctatgtacatatctatctacttctgactgtagatgggtatatagatagatgccaaagcttcttatggttctgggggtagtatgcatcatttattggggtctctgcctttaaacacatcaaaattcattttagaca

SEQ ID NO: 1534 - DNA, 213 bp, Homo sapiens
gatacaaaatgcaaaatccacaattttgataaactgaaaattgccaatttgttttgcagtactttattatattggggtggccttgtcctttttgggcttttagttagctaatgaatgaatacattagacacttttgggttttagttgggattttacatagcttgcattttaattctttggttctttgctgtttctattaacccacagcattat

SEQ ID NO: 1535 - DNA, 259 bp, Homo sapiens
agccgccggtgctgttgacccaagggccgtggtccacggtacttgaagaagccagagcccacatcctgtgcactgctgaaggaccctacgctcggtggcctggcacctcactttgagaagagtgagcacactggctttgcatcctggaagacctgcagggggcggggcaggaaatgtacctgaaaaggattttagaaaaccctgggaaaacccaccacaccaccacaaaatggcctttagtgtatgaaatgcacatgga

SEQ ID NO: 1536 - DNA, 258 bp, Homo sapiens
ttaaagagccctccatcttgcctcttggccgcttcttccaaactttcccgggatttgtctcggaaactttcggagcgaggcggaggccgtctttccgcctcggaatcggaggagctgttttgattcgtttctgattcattgactagagacgatttgacatcagctaaatccctctctgccgaggagttttcggagctcttctcctcctgttcgccctcgtctttgaaggaaatcagttcgtcgttggcgcctaggtca

SEQ ID NO: 1537 - DNA, 296 bp, Homo sapiens
gagatatccgtagatggtttatagaaatgcatttgactttggtaaactgatgaattactggaataaaaagatgtccaacaaactcttattccagtaatccctctttaaattttttaaggacaaacatatcatctgaaaatcatgatattttgtttcttttcatgacgtagatatattttatcttgtcttaactgtgctggccggactctccattacaaagttgaagagcagtggtgatacagagggcatccctgacttgttctgatgttaaaaggaaagcttttattgagtgatag

SEQ ID NO: 1538 - skipped

SEQ ID NO: 1539 - DNA, 222 bp, Homo sapiens
aacatcaaggctcccaagatctcgatgcctgacgtggatgtgaacctgaaggcccaaggtgaagggtgatgtggatgtttcactacctaaggtggaaggtgatatgaaagtgccagaggtagacattaaaggtcctgaagggaagctcaaaggtcccaagtttaagatgcctgatgtacatttcaaaagcccacaaaggctaaggtccacatctggatgtga

SEQ ID NO: 1540 - DNA, 150 bp, Homo sapiens
ccatgccgagcgcaggaaggactttgtctctgaggcctacctcctgacccttggcaagttcatcaacatgtttgctgtcctggatgagctaaagaacatgaagtgcagcgtcaagaatgaccactctgcctacaagagggcagcacagtt

SEQ ID NO: 1541 - DNA, 190 bp, Homo sapiens
  misc_feature (149)..(164): n is a, c, g, or t
gcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgannnnnnnnnnnnnnnngtactttggaacgacaaaatgaaaca

SEQ ID NO: 1542 - DNA, 261 bp, Homo sapiens
ttcaccctgtctgggtggaagtcctggggcgcgtcacggatgtcagccatgaaggggctgaggcggatgtcttcgctgttgcacagcacgtgaacggcatactcgccagcctcctgcggccagtagcgcacatcacaggagccgtcgcccttgtcgtcacattcgatcttagcctgcgatggcccttccaccgagaagcccagcgtgcccacgtcgtccccgatagcctccaccacaaagtctgctgacttgccaacgacg

SEQ ID NO: 1543 - DNA, 250 bp, Homo sapiens
tccttgttttcttggttagtgattcatttgcataaacattaatgatctctgcatactggtttggggttttctctttccttctaactctaaagaaaaaatttttgctgcagaattatcctcagaagaggcttcctggccttcatctaccctgcagtctgaccaagtatgataaattttagccgttttcaaggaaacatctctctacccaggtcattgctgtcactacagctttcaagtcaccacactaatt

SEQ ID NO: 1544 - DNA, 272 bp, Homo sapiens
catttcacgaataaaagttactacgtgaaaaatcccagtaatggaatgaaggtaatattgataagctattgtctgtaatagtttatatattgttttatattaaccctttttccatagtgttaactgtcagtgcccatgggctatcaacttaataagatatgtagtaatattgtactttgaggacattgtcaaagatttttattgtgaaaaatgagagctgtaactgaggactgtttgcaattgacataggcaataataagtgttgtactgga

SEQ ID NO: 1545 - DNA, 296 bp, Homo sapiens
gagggcatagcgctcatgaaacacagcatcacagtaacggcatttcttgccttgcccaatataggaatgctgctttcgcaagtggacacccaaatcactttttcgggctatgactgtgtcacagtggggacagtgaagtttggccgcattttctgtgtgcttctgtaaaatgtgcatcttcatggtaccactttgggtaaaccgagcatgacaaatataacattcataaggcttttcccctgaatgggttctcatgtgccttttcagcttgtatgtgtccccgctggactacagca

SEQ ID NO: 1546 - DNA, 265 bp, Homo sapiens
ggtacacaaatctggttctcaatggtgaggtgggatcagagatattctccctgttgttcagaggaacaataattcggatgtttctctccacaatgtcctcattaggatcttcggaagaacggatgatcctggaagtaatccgggcacacttacatttgttgtcaacaagaacaatcctttcatcttcttgggctttcacatgaacagccttaataaaaaccgccaggactccccagaaaagcaaatggttcttcatcttgacttc

SEQ ID NO: 1547 - DNA, 256 bp, Homo sapiens
cagcccacgcttaggaatgcttggcctctggcaggcaggcagctgtacccaagctggtgggcagggggctggaaggcaccaggcctcaggaggagccccatagtcccgcctgcagcctgtaaccatcggctgggccctgcaaggcccacactcacgccctgtgggtgatggtcacggtgggtgggtgggggctgaccccagcttccaggggactgtcactgtggacgccaaaatggcataactgagataaggtgaa

SEQ ID NO: 1548 - DNA, 264 bp, Homo sapiens
gttcttacgggtctgagcctctggatgctctctcagatttctgctgtggatgaagggactcagctgctcgctgcaggtcacctgacctccctcatgccgtcacccatccactctgacgggtgggtcatatgcagaagcttctcagcacctggccaagttgtagccgatggtctgtccgaaaatgctggttcactctccactggccaactgtctgtctgcactgcactgccagttgcctcttgcctgcgccattgcgctaacatc

SEQ ID NO: 1549 - DNA, 255 bp, Homo sapiens
ctttcctcacacaatttggaatcatataatataagtactttgtccctgattaaataatgtgacggatagaatgcatcaagtgtttattatgaaaagagtgggaaaaggatatagctttttaaccaaaaggtgttttgccccattcctaagaaaatggagcggattaatatagaaaaataagtgtggggcattttctttccctggttaagggggaaaatggtatgtgggtttgaacatttttcttcccccaattgc

SEQ ID NO: 1550 - DNA, 217 bp, Homo sapiens
agcttagggaaatttcacagttcattgtggagtgttaaacttagaacatgtgtaacttttcacataaagagaatgcatctttgacagttatcttatttgtaaggcagcctataaaatagttctgaagtattttatttacctaactataattattgggccagatacttgttaataaatgggcttaatgttaacatggatttcatatgttctgtgtggt

SEQ ID NO: 1551 - DNA, 272 bp, Homo sapiens
gtgagtcaagaaggccctcccctgtcggcgtttgatctctccagcagcaaacatcgcacatggattcttgcagagcttctcctgcggctgttccgaagaatcctggggcttccaggacacgggggctgtggtttaagcaatagttttcccagcagctgtccccgtctgctcggaagtgggctccccgaactctgccgctcttagtgaaaacttccttttcataacattctccacctccaccttctcttcaaagggcagcctgtcctcaagtc

SEQ ID NO: 1552 - DNA, 263 bp, Homo sapiens
tcggctccggtgaccgagtacgcgtgccccttcaccagcttctgaaacgtgaatggcctccgagtccccggcgctggtgatgtcgatggagcagccaaggagagagcctttttgcagagctttctggatgatcttgaacaggttgggagggggcttcttcaactcataccactcagcaatgctccggtgaagtcttcgaagccctcagtggtggcaccccctgatagtgcttcatagcatccgttgatcttgcgtatgccttc

SEQ ID NO: 1553 - DNA, 184 bp, Homo sapiens
ctaagactactaaggccttttatgtaatttctttaaatgtgtatttcttaagaattcaaatttgtaataaaactatttgtataaaaattaagcttttattaatttgttgctagtattgccacagacgcattaaaagaaacttactgcacaagctgctaataaatttgtaagctttgcatacctt

SEQ ID NO: 1554 - DNA, 208 bp, Homo sapiens
accttaaaggccgtcatttcattagtattcctcattctgcatcctggcttgaaaaacagctctgttgaatcacagtatcagtattttcacacgtaagcacattcgggccatttccgtggtttctcatgagctgtgttcacagacctcagcagggcatcgcatggaccgcaggagggcagattcggaccactaggcctgaaatgacatt

SEQ ID NO: 1555 - DNA, 288 bp, Homo sapiens
gaaagaatccatccttaaagtcaaaaactaatgatggagaagaaaaaatggaaggaaatacacaagaaacggagagatgtgaaagggcagaatcattagcgaaaataaaatcaaaggccttttcagttgtcatacaggcatccaaatcaagaaggcatcatcaagtcaaactcgactcttcggactctgattctgcatctggtcaaggcaagtcaaagcaactaggaaaaaagagaagaaagaaagagtgaaaccagcaggaaggaagatgtctctctagaataatac

SEQ ID NO: 1556 - DNA, 138 bp, Homo sapiens
agagaagcggttcagcctttttggcaaaaagaaatgaactcctttccttcacctcctgcccttctcttaccttttcagtgaaattccagcatgcaagctcagaaccaacacattactctctgtgcctaatgttcctca

SEQ ID NO: 1557 - DNA, 32 bp, Homo sapiens
gtgttatatgagcatgatttggtaacttcagg

SEQ ID NO: 1558 - DNA, 236 bp, Homo sapiens
ttaatccggaagaatagaatggcactttttcaacatttgacttgtgtaattccaatcctggatagtctactaactgccggaattattaatgaacaagaacatgatgttattaaacagaagacacagacgtctttacaagcaagagaactgattgatacgattttagtaaaaggaaatattgcagccactgtattcagaaactctctgcaagaagctgaagctgtgttatatgagca

SEQ ID NO: 1559 - DNA, 235 bp, Homo sapiens
tctggtccctcaatgtcaatgtctggcccactgacatccacatgtggccctttaaggtccccttccaatgtgggaacatctacatccacctctccttttgccttggggctcttcaagtgtagatcgaggtctggcatagagattgtgggagctttaaagtgcatatctggcatctggaacttagaagttttccacttgccatttgggccttccacagctacttctggcatgccag

SEQ ID NO: 1560 - DNA, 293 bp, Homo sapiens
  misc_feature (169)..(169): n is a, c, g, or t
aagtcttcctgttgtacagtcatcaaaatgaccaggtttgtgctgcaaaggagccagcaccatgtggctactgctttgattgttctcagatgaatgtttatacaaaataatatcttatcttcatttagtttataaacatacacagtgctgtccctttcaaattaagganaaaaaccacacacacaaatactgcaaagtagcaaaatacaaaggaaaacaaagctacttttggttttggcaacattaaaaaagaaagaaatataaaaagcaatgtggcattggtccctattcat

SEQ ID NO: 1561 - DNA, 296 bp, Homo sapiens
  misc_feature (94)..(94): n is a, c, g, or t
atgcatagatatacacaccacgcccccaccgcgatgttaacgacaccgcgagataatactattccccccacactgcgtctctgttctgtttctnagcacacctctcacctctcctcttatctctgtggcggtcgagaacattgcactcaccccactatttatctctattctttctctattactgaccaacatatcctctgtgcgcaccctcgcgcggaaacaacaacatcgtgtacacaccacaagaagtaagcacatgattgctagcctgggacaccgcgccctcataatatata

SEQ ID NO: 1562 - DNA, 268 bp, Homo sapiens
gttcacccggtgaactatttatgagttcttctggtgtgaagaaagggctcatgttgcatttccagccattgctacaaagaacctttatttgttcagtaagcggtagaaaatccttccgcgattaaaaacttcagacttgctgaatatcctgcaatgtcaagatgaccgatgttgagttgggtggatttgctaacgagtcagatttgaacatgaggctattggaacacaataggcgtcattgatggcggcaagccatagctttcaagtt

SEQ ID NO: 1563 - DNA, 55 bp, Homo sapiens
gtaaaccaagttttatattctgcaatgcgaacaggtacctatctgtttctaaata

SEQ ID NO: 1564 - DNA, 297 bp, Homo sapiens
gataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatatt

SEQ ID NO: 1565 - DNA, 231 bp, Homo sapiens
ttttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgttt

SEQ ID NO: 1566 - DNA, 203 bp, Homo sapiens
taatggtgaaggtgctgaaccctcagcaggagggcagtttgagtccctcacctttgacatggagttgacctcggagtgcgctacctcccccatgtgaggagctgagaacggaagctgcagaaagatacgactgaggcgcctacctgcattctgccacccctcacacagccaaaccccagatcatctgaaactactaactttgt

SEQ ID NO: 1567 - DNA, 118 bp, Homo sapiens
gaaattccggacattaatctggatgtcccacattcatactctgtgctggagcggtttgtagaagaatgttttcaggctggataatttccttacaactcagagatctttgtccttcaag

SEQ ID NO: 1568 - DNA, 239 bp, Homo sapiens
tgcatttattcagctgtccagtgttctccaagaagcaaactggattttcttctctactttccaaagctacttcagagaagcgcacttccgtgtgcgcctgggccaggcagcgccccgtcgctgcgctggctggggtcgaccggcaggctcgctaggcggccagccccgcggggccccagcgtgcgcgcgcccagggctgaggaggggtcgcggcgaggacagccgggactgggcgcagg

SEQ ID NO: 1569 - DNA, 248 bp, Homo sapiens
  misc_feature (188)..(198): n is a, c, g, or t
gaatctgaatgtttattcattatattgttacaatttaacattaacatttatttgtggtatttgtgatttggttaatctgtataaaaattgtaagtagaaaggtttatatttcatcttaattcttttgatgttgtaaacgtactttttaaaagatggattatttgaatgtttatggcacctgacttgtnnnnnnnnnnnctacaaacaaatcctctagaatcattaaattgtgtccctgtattaccaaa

SEQ ID NO: 1570 - DNA, 298 bp, Homo sapiens
accctgtttctggaaggccctagctcaggtggcttcagggcctccggaccccccctgggaggggtggccacgtgctggctgcggaacccagggcaggggtgggaggggcctccagcactttttatatttacgtattctccaaagcagtgttcacacgggagccagcctgtgcccccagcctcctggaaaacaggttggcgctggaggagccgggtcttggcatcctggaggtggccccactggtcctggtgctccaggcggggccgtggacccctcacctacattccatagtgggccc

SEQ ID NO: 1571 - skipped

SEQ ID NO: 1572 - DNA, 228 bp, Homo sapiens
tggaccccgctcacgggtacatgtactggacagactggggtgagacgccccggattgagcgggcagggatggatggcagcacccggaagatcattgtggactcggacatttactggcccaatggactgaccatcgacctggaggagcagaagctctactgggctgacgccaagctcagcttcatccaccgtgccaacctggacggctcgttccggcagaaggtggtga

SEQ ID NO: 1573 - DNA, 151 bp, Homo sapiens
aatgtaaataactcacgtatagtggggaggggagttccaagtgtgccctcctctcttactcctgcctggattatttaaaaagccatgtgtggaaacccactatttaataaaagtaatagaatctgcaaagttggacggagcgagaattcgt

SEQ ID NO: 1574 - DNA, 179 bp, Homo sapiens
tcctgagccgggattgtccaattactaaaatgtaaataactcacgtatagtggggaggggagttccaagtgtgccctcctctcttactcctgcctggattatttaaaaagccatgtgtggaaacccactatttaataaaagtaatagaatctgcaaagttggacggagcgagaattcgt

SEQ ID NO: 1575 - DNA, 168 bp, Homo sapiens
ggacctgtcccgtagagcatgtgccagcaggatggaggagatccaggctgtgtcgctgtagccgatcccaaactcctgtatgagctccttgaagaagacactgacggccttggggaaggcgtaggagaagccagtgatgacgaaacagccgaagagcactggaccagc

SEQ ID NO: 1576 - DNA, 278 bp, Homo sapiens
aaggccaagtgcgtgatctttgagaggttttggtaggtaagaaaggaggactctatgcatgtgtgatggcagtcgggggtggtaatttgggaacacttcatctacctttgttcctttgtttgtactgttttcttaaacctgtggaatgttttcccacttcccctgcgcaaatcccaccagccaacagcttcttcagctacaactgtagcattcctctgcagtctctcctttgtcgactttctttcatagtgactgcatctgacctattcttgccctgc

SEQ ID NO: 1577 - DNA, 246 bp, Homo sapiens
aagtcattactttgcatttactaataagacaacagcctgtggatacattagacctttataagaacacttctaggaaatgttagaacaacgagtcattaaaaaggaatataaatgagttcataaagataaatgtatagctgacaatttctttggtcctcgaagtcacacttgtttttactttaaaatgccaaacatgagttgagtgctcagaattctacctataaatgtctaaatattaagcaggct

SEQ ID NO: 1578 - DNA, 243 bp, Homo sapiens
cagccctacagacttgctgtgtgacctcaggccagtgtgccgacctctctgggcctcagttttcccagctatgaaaacagctatctcacaaagttgtgtgaagcagaagagaaaagctggaggaaggccgtgggccaatgggagagctcttgttattattaatattgttgccgctgttgtgttgttgttattaattaatattcatattatttattttatacttacataaagattttgtaccag

SEQ ID NO: 1579 - DNA, 231 bp, Homo sapiens
tgcttccttttcaagaaggtgccgtatacgtcttatataaaaatatacattccattaatcttatatccactccctaaccactaaaatgcaaatgaaaatattcttcagactccagcaccagcagaattgttctgtatgagcaattcaagagctgtctgaggcaaaaagatatttcagctaccaaattaaacttgggtagcttacgcatgggtgagtaaccctgggaattct

SEQ ID NO: 1580 - DNA, 294 bp, Homo sapiens
ggaaaggccggttcatgccatgaatggtggccaggtcacctcggcggccggtagtgaacccgttgatgtccacttgcagtgtgttatccctgctgtcacaggagcagtgggcgctaaggcgaaagccctcaatttcccctccacggctcaaccactgccgcacaactccggtgacatcaaaagataaccactctggcgagtcgctgggtgccagcagccggttgctgaggtatcgccaggaattgttgctgtatttctggtacagctccacgtgctgctccacttttaacttga

SEQ ID NO: 1581 - DNA, 299 bp, Homo sapiens
aaatgcttggcctagaagatgacatgcatgaagaccccccaataccactgctgtgtccttcagtattaattttttcctttttgaacaggtccaatgatttcagatcttctggaaaaggcttattgtcatttgcttctatttccacaacacttacatcagtgaaattgccatctgaatacatttgatcttccgaattaaaattgtgccttggaggagtgtgaggtgaccactgggcaatatgactctttgaaggatctggaacattaggccagatgtgtaaacaattaggtctcgcttat

SEQ ID NO: 1582 - DNA, 73 bp, Homo sapiens
gtacttttccactttggattttgcaaatgccccctaaccctttactggttgtccctatggggaatccaagtgg

SEQ ID NO: 1583 - DNA, 214 bp, Homo sapiens
gtccctactgcatagaagacacaattccaaagaaggtggtgtgccacttcagtgggaaggcctatgccgacgaggagcggtgggacccttgacagctgcacccactgctactgcctgcagggccagaccctctgctcgaccgtcagctgcccccctctgcctgtgttagcccatcaacgtggaaggaagttgctgcccatgcgtccatgtaagg

SEQ ID NO: 1584 - DNA, 284 bp, Homo sapiens
tgcattgatagcgtaattagctgtttctctgagtcctgcccttctgcatcctgtgaaagacctgtcttgagaaaaggccagtgatgtccctactgcatagaagacacaattccaaagaaggtggtgtgccacttcagtgggaaggcctatgccgacgaggagcggtgggacccttgacagctgcacccactgctactgcctgcagggccagaccctctgctcgaccgtcagctgcccccctctgcctgtgttagcccatcaacgtggaaggaagttgctgccca

SEQ ID NO: 1585 - DNA, 297 bp, Homo sapiens
agtatttcactacatctcagttggtgggtgttaagctagaatgggctgtgtgataggaaacaaatgccttacagatgtgcctaggtgttctgtttacctagtgtcttactctgttttctggatctgaagactagtaataaactaggacactaactgggttccatgtgattgccctttcatatgatcttctaagttgatttttttcctcccaagtcttttttaaagaaagtatactgtattttaccaaccccctctcttttcttttagctcctctgtggtgaattaaacgtacttgag

SEQ ID NO: 1586 - DNA, 252 bp, Homo sapiens
gttctaaccctatactgtagtattctttggggtgcccctctccttcttagctatcattgcttcctcctccccaactgtgggggtgtgcccccttcaagcctgtgcaatgcattagggatgcctcctttcccgcaggggatggacgatctcccacctttcgggccatgttgcccccgtgagccaatccctcaccttctgagtacagagtgtggactctggtgcctccagaggggctcaggtcacataaaactt

SEQ ID NO: 1587 - DNA, 133 bp, Homo sapiens
actacttctaatctaatcactagagttattatattctgttatgtttgaccagaattatatgacaagaactggtgacagtttagtgcctctgcccattgtccatgatttacactaattgtgagcagtcttctta

SEQ ID NO: 1588 - DNA, 204 bp, Homo sapiens
aggatccgagtggtagtgtttctgagagtcagggtctaggtgctggagtgcgcacggaggccgatgtagaggaggaggccctgaggaggaagctggaggagctgaccagcaacgtcagtgaccaggagacctcgtccgaggaggaggaggccaaggacgaaaaggcagagcccaacagggacaaatcagttgggcctctagcgt

SEQ ID NO: 1589 - skipped

SEQ ID NO: 1590 - DNA, 286 bp, Homo sapiens
cattttatctgctataaggagaattttggtagggctaaaagtggaagcagtccttatcaggaaacccaaacatttataacttttgggaatttctcactcctgggactggctttagaaagtgatccaaaattgtaaggggagatcatcagtgttttggtcagcctggcaatttagtccacttgctctggtgatggctgcccaatttcttatttttcttttgagaaatcacatccttccctcacccatctctagtccttagggtgggctgactctacaggatgggtac

SEQ ID NO: 1591 - DNA, 252 bp, Homo sapiens
aaggacggcacggtcactgttagatatgcccccactgaggtcgggctccatgagatgcacatcaaatacatgggcagccacatccctgagagcccactccagttctacgtgaactaccccaacagtggaagtgtttctgcatacggtccaggcctcgtgtatggagtggccaacaaaactgccaccttcaccatcgtcacagaggatgcaggagaaggtggtctggacttggctattgagggcccctcaaaa

SEQ ID NO: 1592 - DNA, 167 bp, Homo sapiens
tctgtctgaaccacgcgggggccttgagggacgctttgtctgtcgtgatggggcaagggcacaagtcctggatgttgtgtgtatcgagaggccaaaggctggtggcaagtgcacggggcacagcggagtctgtcctgtgacgcgcaagtctgagggtctgggcggcg

SEQ ID NO: 1593 - DNA, 210 bp, Homo sapiens
  misc_feature (93)..(93): n is a, c, g, or t
tgagggacgctttgtctgtcgtgatggggcaagggcacaagtcctggatgttgtgtgtatcgagaggccaaaggctggtggcaagtgcacggngcacagcggagtctgtcctgtgacgcgcaagtctgagggtctgggcggcgggcggctgggtctgtgcatttctggttgcaccgcggcgcttcccagcaccaacatgtaaccggcatg

SEQ ID NO: 1594 - DNA, 263 bp, Homo sapiens
aagtgcagggtcagtactccagcgccctctcatcagacaatgaattctgacactggctgtaagttttctgtgcagtaatacagatccttaagacattgccccaggcaatgcccataatatcctaaaggttccttgaagttaagtttcaaggatcaagtttcagttttctattttagaatagaaacattactcttgggttcaatccagtagctcatctgccccccagtctccttaggcactgattccttcatgctgtgctttga

SEQ ID NO: 1595 - DNA, 275 bp, Homo sapiens
atcacatgaatatatctgcctgacaaaaatttgggaagtccagcatctctgatttaaaaagaagaaactatttgtaattttagtctcttgttcttaatgcaggatctgaccattggttagtaatgcaacagctgcgattagcaatgaaggaaaactattttcagagtcttctcatgacctagccacattagcaatctaaaaatacaaacaggaaaagtttttaaaagcttaaccttttataaagtgactaaactgcataagccatcagccacaga

SEQ ID NO: 1596 - DNA, 293 bp, Homo sapiens
caccggaggtagttgatagatcgagaatacacaaggacactcacagtcacacatagaacctagaaacaacactccccaaaacagatgtagattcaacaaaatactataaaaagccataaagcatattcagtatataatgtttaaattgttctgacatatatgttgtttgtatacccgcacaaatgttactgtcattaaactaatgatcctattttcttcttctcaaaaaaagtcctagaaatctgtttgtgatggcttgatgaagtttagtcactttataaaagccaccttgg

SEQ ID NO: 1597 - DNA, 57 bp, Homo sapiens
ggtaagatatggctacaaacagatcaaaacttccacttcaagatgctagaaagaagc

SEQ ID NO: 1598 - DNA, 291 bp, Homo sapiens
  misc_feature (191)..(191): n is a, c, g, or t
  misc_feature (231)..(231): n is a, c, g, or t
aaacccgcgctaggtaaattctgctatctggccgtcaacacgctgttttcaccagctcatctagtcgcgcctgaatagtagcgccgctacccgcggggcccgcgtctatttcttttattagtcgccgccgcgcggtgtgcattatatctcaatccttgcgagtcgcgtgaatgcggagcgaatttgtgagncacgcgagtgggccgcgccgcacggggacgcctttcgctncccatcattcccactttacggccgtccggcccagccggtcgcgtattacttgccggtggc

SEQ ID NO: 1599 - DNA, 255 bp, Homo sapiens
tacttaggcgagtaccatttgcacaatcactgttttacttatgagcagatacagatatatccaaacccttacctactaggtatcctgctagggttttcaattccaattcttgtattaagttttttcctttcagttttaggtgcgaaagtaatcagtcaatccaatatcccccatctttgtcttgaaacaaaaactgttttaagacgtctacgttgaattattcagagaattaagcaataaaagctcacaccttat

SEQ ID NO: 1600 - DNA, 178 bp, Homo sapiens
ttaagacagcactcctttacagggagtcaggtttggtaaatataaaggatacataaaaaatacagtataaactgcataagcttaacagtagcaaaaacactgatgaacttttaaaaagtcaaaaatatataaaaatattagcctgaaatggcaaattttcaaacaccgatctgtgtaa

SEQ ID NO: 1601 - DNA, 224 bp, Homo sapiens
gattctgataaaatagacattgctattctgttttttatatgtaaaaacaaaacaagaaaaaatagagaattctacatactaaatctctctccttttttaattttaatatttgttatcatttatttattggtgctactgtttatccgtaataattgtggggaaaagatattaacatcacgtctttgtctctagtgcagtttttcgagatattccgtagtacatat

SEQ ID NO: 1602 - DNA, 197 bp, Homo sapiens
atagtattgctcgtagcctttcggcataggatttgctctccatacacaggcagaagaggagccgccgccacagtagatgctttcatgccatttcccaaacagccgatgaaccgcttttccactcctgtcaaacactgtgccttcaatctcatgggcattagtgctccagtattttgcctttataaaattcactttca

SEQ ID NO: 1603 - DNA, 294 bp, Homo sapiens
agtaggcggctttggccttcagcactgctccaaactcatacaaatgaaacatccatttccatcttcttttacttccccaaaaagtaagcttctcagcttgtctttacaggtatacacaaaaccaccagctgctgtgtctgcattcatgagtggatgtacttgtcttaccagatgtttgtagctcaaaggagggcctttttcaaaaagatggaaccaggaacaggaaactgacaagaggtcagagtgggtgccaagtgggatgggaagcaaacaggtacaaatggccggacgcgt

SEQ ID NO: 1604 - DNA, 217 bp, Homo sapiens
gaacattctggatagcaagcccactgcaaacaagaagtgcgacctgatcagcatccccaagaaaaccacagacacggccagtgtgcaaaatgaagccaagttggatgagattttaaaagagatcaaatctataaaagacacaatctgcaatcaagatgagccgtatttccaagttagaacaagcagatggcaaagatagcagcctgaaggtcccacc

SEQ ID NO: 1605 - DNA, 192 bp, Homo sapiens
  misc_feature (57)..(74): n is a, c, g, or t
agcacatactggtacccctgagaggagctgcctgtgaaagctataaagacagaaaannnnnnnnnnnnnnnnnnccttttcccgacccatggggtttaaatttccaaacttgtggggaaggcaaggctgatgaagaacttgaccttttggaacaaaagaaaattgaaagcggcatttcttggcaaagggttt

SEQ ID NO: 1606 - DNA, 261 bp, Homo sapiens
  misc_feature (126)..(143): n is a, c, g, or t
tatcatccagtgcagtcctgggtcaacttgtttctccaacaaagactggagaagtcacgaagagagcctagcacatactggtacccctgagaggagctgcctgtgaaagctataaagacagaaaannnnnnnnnnnnnnnnnnccttttcccgacccatggggtttaaatttccaaacttgtggggaaggcaaggctgatgaagaacttgaccttttggaacaaaagaaaattgaaagcggcatttcttggcaaagggttt

SEQ ID NO: 1607 - DNA, 150 bp, Homo sapiens
agcatcctgcctgcgtggactggctgctaatggagagctccctggggttgtcctggctctggggagagagacggagcctttagtacagctatctgctggctctaaaccttctacgcctttgggccgagcactgaatgtcttgtactttaa

SEQ ID NO: 1608 - DNA, 144 bp, Homo sapiens
tgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatatt

SEQ ID NO: 1609 - DNA, 156 bp, Homo sapiens
tgacacattaaaatacttctacagtgacaaagaaaaatcaagaacaaagctttttgatatgtgcaacaaatttagaggaagtaaaaagataaatgtgatgattggtcaagaaattatccagttatttacaaggccactgatattttaaacgtccca

SEQ ID NO: 1610 - DNA, 104 bp, Homo sapiens
aaagaccaaggaataacattctgtagttcctaaaaatactgacttttttcactactatacataaagggaaagttttattcttttatggaacacttcagctgtac

SEQ ID NO: 1611 - DNA, 249 bp, Homo sapiens
tgcacggcattaccccacacagggtggcagaacttgaagggttactgacgtgtaaatgctggtatttgatttcctgtgtgtgttgccctggcattaagggcattttacccttgcagttttactaaaacactgaaaaatattccaagcttcatattaaccctacctgtcaacgtaacgatttcatgaacgttattatattgtcgaattcctactgacaacattataactgtatgggagcttaactttata

SEQ ID NO: 1612 - DNA, 206 bp, Homo sapiens
ttactgtaccgcctgttgtatctgggagcctcgtacagaggctcgcacagcagtgatcaagtgtcatcccttacgtgactgggggatgtctgtcctaaaagctgactgctaggatagtaaggatcatcttgcctgggctatgccactgtcttgttaccaattagacatctggaatttcataattagttttcattgtcactgtcaag

SEQ ID NO: 1613 - DNA, 206 bp, Homo sapiens
cagttgttgaagtgtagcagcagctttttgcagggaaagagggagttgtatttattgcttctccatgacatggttcttttctcattagttcatgggcaagtcaagggaaagagacctaggtagcagctgagtctgtagcctacagatggcctgggctggcttggctcagtcacttcccttagtcacttccacacattccagaaatt

SEQ ID NO: 1614 - DNA, 219 bp, Homo sapiens
ttataccaagatcaaacaaagccatgatttctgtttcactctgcattgggctaattgatgtttggacagttcaattctgataacagcagcgcacactctaattctctctgggaagtgaaggaaacactgccctgtattttcctgacttcaggcttatactctggcaatcttccaaaaacttcccatggctgcccatcttacttccaacaatccctgaac

SEQ ID NO: 1615 - DNA, 300 bp, Homo sapiens
  misc_feature (219)..(219): n is a, c, g, or t
ttgttcacagtgttggcacatggtaagggctaagacacttgattagcataatattcaaaattagaaattgtacactattgtactctctttcaaaaggcaaacagcctaaaactgtttggaaaaaacagcttgtacagtatattgtacacttcctgtgatagactagtggactgatacacccactaatgcacagcagtaatagtccacctctttacacanttatgcatgttaagtgacaaaaaaactcactttaaaaggccaaatgataaaaacatcagccttgaggctcttcgatataga

SEQ ID NO: 1616 - DNA, 168 bp, Homo sapiens
ctcagaccctgccaaataccattctaattctgttctgtttctatgagtttgacttttttagattccgcatgtgagaacataaagtatttgtctttctctgtctgacttagcataatgccctcaaggttcatccattttgttgcaaatgacagaatttcttacttttct

SEQ ID NO: 1617 - DNA, 226 bp, Homo sapiens
taaagtctgtacctttgatcatcatcttcccatttcctcctcccctcagaccctgccaaataccattctaattctgttctgtttctatgagtttgacttttttagattccgcatgtgagaacataaagtatttgtctttctctgtctgacttagcataatgccctcaaggttcatccattttgttgcaaatgacagaatttcttacttttctttgcctgaaataat

SEQ ID NO: 1618 - DNA, 268 bp, Homo sapiens
ccggcagcacctttatctatggttatgtggatgcagcatataagccaggcatgtctcccgaggagtgcaggcgcttcaccacagacgctattgctctggccatgagccgggatggctcaagcgggggtgtcatctacctggtcactattacagctgccggtgtggaccatcgagtcatcttgggcaatgaactgccaaaattctatgatgagtgaaccttccccagacttctctttcttattttgtaataaactctctagggccaaaa

SEQ ID NO: 1619 - DNA, 291 bp, Homo sapiens
ggcaatttcttacactaacctgattatgaaaaaaagaagtctgtatcatctgcttccaagtctgttatgtccaaatatattttaattatgcatttattttgctacttttataaatattagagatttcaccttaaattatttttgtaactagttctagaacatgttttccaattattatttttctaatggagacatataattgacctatgtttatgcatatatgttctctacacagtgaaactttttttaaaaagaatagtaaagaaaatgcggaagctctggctctccaag

SEQ ID NO: 1620 - DNA, 289 bp, Homo sapiens
ataccttgagggaagtctgcgatgatgaaagagattgtattgctgttttggaaagaattagcagattggccgatgattcagaaccaactgtgagagcggagctgatggaacaggtgcctcacatcgcactgttttgtcaagaaaaccggccttcaataccatatgctttttcaaaattcttactacctattgtggttagataccttgcagatcagaataatcaggtgaggaaaacaagtcaggcagctttgctggctctgttggagcaggagctcattgaacgatttga

SEQ ID NO: 1621 - DNA, 298 bp, Homo sapiens
ggtaggcgtcaatgtcacttactggaggggatcccagccctaagagccctttctcagtggcagtatctccaagcctggacctcagcaagatcaaggtgtctggcctgggagagaaggtggacgttggcaaagaccaggagttcacagtcacaatcaaagggtgctggtggtacaaggcaaagtggcatccaagtattgtgggcccctcgggtgcagcggtgccctgcaaggtggagccaggcctgggggctgacaacagtgtggtgcgcttcctgccccgtgaggaagggccctatga

SEQ ID NO: 1622 - DNA, 60 bp, Homo sapiens
gaggctgccccaccgttccggccatagcaaccatgagtggcatggcccacaccacggtgg

SEQ ID NO: 1623 - DNA, 230 bp, Homo sapiens
tgtcggtgttgctgtccctgttcgtgacatctgtcctgctctgcttcatcttcggccagcacttgcgccagcagcggatgggcacctacggggtgcgagcggcttggaggaggctgccccaccgttccggccatagcaaccatgagtggcatggcccacaccacggtggtcactggaactcagtgtgactcctcagggttgaggtccagccctggctgaaggactgtgac

SEQ ID NO: 1624 - DNA, 286 bp, Homo sapiens
tgccattgagtctggagggccctgttggagcctttggacctatagctcaaggccagaaaaatcactggctttggaattaaatagcttagattgtactataaccactacttatgaactcagggactatgagggactattcaggggctatgaatctgagcctttgtttcttgaactgtaaagtggagatgatgtaaaccgccttgcaagattgtagagttgggtaaggtcatgaacataagggcctggcacaaagggtgcactgtaaataaacagacatccctcctta

SEQ ID NO: 1625 - DNA, 266 bp, Homo sapiens
gggatagcaaagatagatcactaacagcgataggaccccagagtagcacagcaagctgggggccctatgagacttcctgtcaggacaagggaagctgaaactccgaaaggcgaagcccagggtcctgtgattggtggggtcagaatttgaacctgggtttgtccccacccatgctgtcctgctataggaggcctaggggtctgcatcagccacggagtcttaagggtgagaagagcttcattcatgccaaaaatgggccagcagat

SEQ ID NO: 1626 - DNA, 185 bp, Homo sapiens
ttggtccggagccacctgcggacaagcgttctgcctgggtcttggctcttggcgtttctttgcagctccatctctccgagtgctcccatctgatacacgtttcaaaagttcaattccagggtagccaaaagtgtgaagctgccatggagaagggctaaaaaacaaccaggaaccaagcaaccact

SEQ ID NO: 1627 - DNA, 242 bp, Homo sapiens
tatgatgcgatcacaaccagcttttacacactgtccttgcacacagacagaggtggaatctgggctacatggagtaccatctacaaccttgggctgcaaaacgaagaagtagccaatgcctttggcttggcagatgagcttgcacctgtcctttggtgagacgccagcgtacttgggaatccattccaccgcaggcccactcccaaaggaagcttttgaaaactcgttgtgtgcttcacatt

SEQ ID NO: 1628 - DNA, 261 bp, Homo sapiens
atccctgtttgtctgcagctttatatatgagttgggcgacattaatatttgttctgcttctatttcagggttgagcagctgcagcttctcaaacacctggacttggatctcatccgagagttctctggccaggccatacagctgccccgatgtggggtccacagccttgaccaccaccctcagcccggtccggccttttacccgccgagcacgttcatggcaaagttgtatctgtgacgggagtcggatcacgcctcgtgt

SEQ ID NO: 1629 - DNA, 207 bp, Homo sapiens
tggaccattgtcacaaccctctgtttctctttgactaagtgccctggctacaggaattacacagttctctttctccaaagggcaagatctcatttcaatttctttattagagggccttattgatgtgttctaagtctttccagaaaaaaactatccagtgatttatatcctgatttcaaccagtcacttagctgataatcacagtaa

SEQ ID NO: 1630 - DNA, 251 bp, Homo sapiens
  misc_feature (208)..(219): n is a, c, g, or t
cccaaatccgaacctcctctgtgaagcattcgagacagaaccttgttatttctcagactttggaaaatgcattgtatcgatgttatgtaaaaggccaaacctctgttcagtgtaaatagttactccagtgccaacaatcctagtgctttccttttttaaaaatgcaaatcctatgtgattttaactctgtcttcacctgattcaactnnnnnnnnnnnngtattattttccaaaagtggcctctttgtcta

SEQ ID NO: 1631 - DNA, 209 bp, Homo sapiens
ccacgcctgtgtacatgtggtttcataaaacatccttaagcatgagctagacattaaacagtcttggagattctagttcagaatttacctcaaacgtgtgaattatggaaattcatggttcatcacagatggttgggatgttgccaagatacatcctttagcacgcctctgtttgctttatgtgaacattaataactctgttccaggag

SEQ ID NO: 1632 - DNA, 273 bp, Homo sapiens
taagcctgtatgtactttgttgtcagcaacttctaggtctttctatctttgccacttctagttcttcctctcttacatatgttacatatgcacatatgcatgtgcacaatcactggtatgaatgcaaagtcaaaagagaaaatataaaaacagcttattttccaaactgctttactaagccctctgcaaagttttagttctttctgctcagatttatgaaataaaaacttcctgtgttaaatgtcaaaaaagtccagcaagatagccttgatt

SEQ ID NO: 1633 - DNA, 277 bp, Homo sapiens
gattcagaagtttctgccggaagttcagtttgtctccaaatctcctgagttgagtagcacactcgacttccagctctgctggagcccgcgcggggctcggttgagcgttcttgcgcgccttcttcccaggcatctccgccggtgccgccgcccactcagctacagagcccgggaacctcagcctccaactggagcacctcggacagctgcaggacgcgagctgaacacgaacagtcctgcaggcagggatggggaatcgggtgtccggacgcgcgat

SEQ ID NO: 1634 - DNA, 211 bp, Homo sapiens
aaatcataaagccttcatcactcccacatttttcttacggtcggagcatcagaacaagcgtctagactccttgggaccgtgagttcctagagcttggctgggtctaggctgttctgtgcctccaaggactgtctggcaatgacttgtattggccaccaactgtagatgtatatatggtgcccttctgatgctaagactccagaccttttgt

SEQ ID NO: 1635 - DNA, 184 bp, Homo sapiens
attgccaagtggagataaaggtgtccatttgggtagggtcaggaagctgtggtattcatgcctcatggcctttcattttcttagagccgtaggggtaaaatcatgccattttttgcctctgtgcctcataagtttgtactccttcctcctttaaaaatcagctgtaagagctggatgtgctgta

SEQ ID NO: 1636 - DNA, 206 bp, Homo sapiens
ttcagctgtgattattctggcaaggtcatccttattttgtatcattaaattgtaccacttccgaagtaatgaactcctctccttggcggagacctccctccagcggcagaaagcctcgtaggcagcgcgcacggcggcgcgggcctctcgcaccccacaaacgcccaccatgcccagagcggcgccgctggcaggagtcttgcacg

SEQ ID NO: 1637 - DNA, 275 bp, Homo sapiens
agagaaccactctaggaaaaaggcggaatagagaatttctccatgtgcctccttcagtggctttccactttcagctgtgattattctggcaaggtcatccttattttgtatcattaaattgtaccacttccgaagtaatgaactcctctccttggcggagacctccctccagcggcagaaagcctcgtaggcagcgcgcacggcggcgcgggcctctcgcaccccacaaacgcccaccatgcccagagcggcgccgctggcaggagtcttgcacg

SEQ ID NO: 1638 - DNA, 248 bp, Homo sapiens
ataactctgtattgtagattatgcagatctttacaggcataaatatttaaactgtaatatgctaacttgaagagattgcaataaagctgcttcagctaaccctgtttatgtttaaatactagggtttgttctatattttatacatgcattttggatgattaaagaatgcctggttttcgtttgcaatttgcttgtgtaaatcaggttgtaaaaaggcagataaattgaaatgtttgtggtatgaggaa

SEQ ID NO: 1639 - DNA, 292 bp, Homo sapiens
gggcagacaggagggcatccttcttcctgtcaaccagttctctgaactggctccaccttgtgttgagtttgtcctgctgggctttgatttccttctcacttgggtggccgctgtgcatcagctggcgtgccatctggttcaccactgcaacccgggaagcctggttgttcatttctggttctacggctctcaatctgtgctggatgtacctccacgatcctccagcttctctgggatctgcatgttgttgagccactgctccttctcgtcgatccagagctcacggcatagc

SEQ ID NO: 1640 - DNA, 282 bp, Homo sapiens
tttcatcgtggcttccttggccatacctcctactccatttcgtcctactagactgcccccttgatccactggcagaaatgatggcaccaccttgtcttcaggtggtgctccttcattattccaaggatgcagcatctctatggtgccaggtatgggggtaaagcctttggcgccctttccgcaatggcacatcagcagtaaaagtggtaccaatagcaggagcagaaaggccaaaatcatgagcgcaattgctgcgggtcccaggcccacataggagtcatg

SEQ ID NO: 1641 - DNA, 255 bp, Homo sapiens
atgttctggcaggatttgctcaaggagccctggtggcctgctgcatagttttcttcgtgtctgacctcttcaagactaagacgacgctctccctgcctgcccctgctatccggaaggaaatcctttcacctgtggacattattgacaggaacaatcaccacaacatgatgtaggtgccacccacctcctgagctgtttttgtaaaatgactgctgacagcaagttcttgctgctctccaatctcatcagacagta

SEQ ID NO: 1642 - DNA, 74 bp, Homo sapiens
  misc_feature (31)..(31): n is a, c, g, or t
ttctactggcttcacattaacaataattttngttgaatttgaattcttaaaaatctactgacaacatttaagtc

SEQ ID NO: 1643 - DNA, 128 bp, Homo sapiens
tcctgaagtacatgccatgtactccccctttatttctaccttggatcaatggcctctgcggagtgtagtgaaagacatctttttattatgatctacactttaaaaaaccaaaggctgcctgtattaca

SEQ ID NO: 1644 - DNA, 274 bp, Homo sapiens
  misc_feature (220)..(220): n is a, c, g, or t
ctcaatccaaaattacccttaagtggaagtcctgaagtacatgccatgtactccccctttatttctaccttggatcaatggcctctgcggagtgtagtgaaagacatctttttattatgatctacactttaaaaaaccaaaggctgcctgtattacatttgctttggggagttgttaagactctgttttttctactggcttcacattaacaataattttngttgaatttgaattcttaaaaatctactgacaacatttaagtcagtgtgaggaa

SEQ ID NO: 1645 - DNA, 38 bp, Homo sapiens
cccaaccacaggcatcaggcaaccatttgaaataaaac

SEQ ID NO: 1646 - DNA, 46 bp, Homo sapiens
accacaggcatcaggcaaccatttgaaataaaactccttcagcctg

SEQ ID NO: 1647 - DNA, 259 bp, Homo sapiens
actaatatgttcaaagtgccaggattcagtcctttctggctatataataggtaactgaaatcaatgcagtgagtgtcgttctccttcattgtaggcagctgaagtctggctttttctccagggtcgtgatctgaagagtccactatcatataggaaccttggggcatctcgggtggtagataatgaggctcttgagcactaacatgcacccattcaaagtcatcatacagatcctggtggtaatcacaggcccctggac

SEQ ID NO: 1648 - DNA, 269 bp, Homo sapiens
ttcaacaaagaaactcaacagatccaagaggggaaacaaagagcctcgggttggtgtaacgacggggcgagcagcagcagcagcggcggccaacagcggcagcctacagcacaccggaggaaggggggtgggggtggtggagaggacagaacagaaccgattaaatacactccggataaaaaaattttagtcgaagagatcaaaaagcagcagcacaggagggagggaaaaagggtggaaaagtcgagcaccaaaaaaggagccccagt

SEQ ID NO: 1649 - DNA, 283 bp, Homo sapiens
cccatgctggcttcttcaacaaagaaactcaacagatccaagaggggaaacaaagagcctcgggttggtgtaacgacggggcgagcagcagcagcagcggcggccaacagcggcagcctacagcacaccggaggaaggggggtgggggtggtggagaggacagaacagaaccgattaaatacactccggataaaaaaattttagtcgaagagatcaaaaagcagcagcacaggagggagggaaaaagggtggaaaagtcgagcaccaaaaaaggagccccagt

SEQ ID NO: 1650 - DNA, 198 bp, Homo sapiens
aaacatcaatagcattcttcacagtacatttatattaagactgtcttctgttttcaggattaacgggttgaaaatttcccattaaaatgcaaattctcacatccttacttgtatttttcctatgttaactgtaagttaatacaagtaaacacggctatattaaaagatcaactactcggctccatagtcctgactcaa

SEQ ID NO: 1651 - DNA, 208 bp, Homo sapiens
actggcattccaggtcagcttggctgtggtcttagaggcagggagtgcctacccagtcctgcctcaggagcagggtgagtagctaaatacagacttaggctttttttccccccttttaagatgcttgctcctctcccttttctttttaccaccctacctttattgttagtggttacaaagtgaccacatattatgtactttgctgtaa

SEQ ID NO: 1652 - DNA, 264 bp, Homo sapiens
gattctctagtatgtaggacagtttcacagcctagataaggtaagtacaatgctcaatattttcacagaacccaatacttcaaagcaaagcatttggctgggtaagcagtgtataagctctttcaactatgccatttatgaggaacaaaatccttaagttgcggatctacaaaggaacgttctttgcactattgtgtgcttgactgtttctttttcatttgttccactagaatcagttagcttcaatgtgtaacaacacgcgcg

SEQ ID NO: 1653 - DNA, 300 bp, Homo sapiens
agtcaatgtagaagttacgcgcataaaagtgttcgatgcagatgaaataggttctgataatgggctggcaaattttacatttgcatcaggaaatgaaggaggttatttccacatagaaacagatgctcaaactaacgaaggaattgtgacccttattaaggaagtagattatgaagaaatgaagaatcttgacttcagtgttatagtcgctaataaagcagcttttcacaagtcgattaggagtaataccagctacacccattccatcatgtcaagtgaacatgtgacgaggctcattta

SEQ ID NO: 1654 - DNA, 171 bp, Homo sapiens
atgtgcacgtcttgctcacgagcagttctattatacatttagctaacaagtaaacagcatatattacatcatcaacttggtgatataataagaaatactacagaattaaaaaacataatgtggatcaaatcatccttgcttaaatacatcaagaacttcccaactacttaa

SEQ ID NO: 1655 - DNA, 275 bp, Homo sapiens
caactttattttgactactttgataacttaaataattctttgttacagtgttacttcgtattagagagaatgtttttattctcaggcgatagatgcaaaaatatttaaagtgcagctcactttcaaacggttcagccaaatgtcgatgatttttgaatctaagtggtgagtatacaaatgttcctcgtattcatcttttatcttttttgtatatttgaaaatttttggaatacaaagttggaaaaaataaatcatgcccaaaagattgccagtag

SEQ ID NO: 1656 - DNA, 84 bp, Homo sapiens
gggaccatcccaaaagacaagccatgcatacaactttggtcatgtatctctgcaaagcatcaaattaaatgcacgcttttgtca

SEQ ID NO: 1657 - DNA, 217 bp, Homo sapiens
  misc_feature (139)..(192): n is a, c, g, or t
gagtgtggcctcgagacagtcctgaccgacgctgctacctagcgcgtgtgcacgaccgcatgccgagcacggtggagcgccagcgtctgggggtgcaccgcgtgcctcaagtccggtctagtgattgcctttggtcgannnnnnnnnnnnnnnnnnnnnnnnnnnnnnnnnnnnnnnnnnnnnnnnnnnnnntttcaatcctgctgcggacgcgagg

SEQ ID NO: 1658 - DNA, 113 bp, Homo sapiens
accatggcaacgaggtagtctgttctatttttggagtatgaaagtagtgccttcttaaatctaataataaatgagagttccagaaaaccagtgcttcaaacaaatttgattta

SEQ ID NO: 1659 - DNA, 284 bp, Homo sapiens
gaaaactgagtcttacacaatgaagtgctacatcttggacattagactgcttgttcctccattagagcagccgactgaccagtaaatcaatccaagagttcaataaggaaagatacaagtgaggctagcaaacgcccaagagactgaaaatacagtggggtggtaatacctcaagaaaccaaacctcatgtgaactagggaagcaagcagtgctccaggtggtctactgacaacaagaccggaggatgcacaaagaagataaaacgcacgtggcgactcaccag

SEQ ID NO: 1660 - DNA, 127 bp, Homo sapiens
ccttttgaaggcacggcagaacgaaagacatcaacaaccttaatttgagcgtcgcaaggcgattccaacatttaccgacaggaatcagggaactggggcctcctcatcctagtccagtgaccggaga

SEQ ID NO: 1661 - DNA, 212 bp, Homo sapiens
cccaagttctaaggtcttttcagagcgtggaggtgtggaaggagtggctgctctccaaactatgccaaggcggcggcagagctggtcttctggtctccttggagaaaggttctgttgccctgatttatgaactctataatagagtatataggttttgtaccttttttacaggaaggtgactttctgtaacaatgcgatgtatattaaacttt

SEQ ID NO: 1662 - DNA, 275 bp, Homo sapiens
tcagctgacaacaacttgcataagggcttaccatgttaaggagctgtcttagatagcaaataaatattccaagcttatctcatgtccaaaactaactcctgattcccgcccctccccaaagtaccttctcttctggcatccttctacatttcagaaatgacaaccgcgtccttcccagtagtttaggtcagaaatcttggagtcatcctggccacttctctttctctgtctttcacctcaattccaatctgtcctcaaatctacctcccagagag

SEQ ID NO: 1663 - DNA, 253 bp, Homo sapiens
gttggatgtctggtgtatgcatgtaatctcttttccacgccttcccgtcggcagcacatgatataaagcaagtattagacaaaaggaccagttgccactgccgagggcacagccagtgtaatcaggaactccgtgtaatagtctctgcttttcaaagaatcagaagggggttagtattctcccaccatcaggtaaaatcccctctccaggaattacttcttgatagtggacccttgcttgtttatcaccaatg

SEQ ID NO: 1664 - DNA, 50 bp, Homo sapiens
aagccttaggttggtaatccggctgaactcggcttgacggcctgaggccc

SEQ ID NO: 1665 - DNA, 222 bp, Homo sapiens
gatgccctaaatgccatcactaagaagctggatgctggcaaccagttggcactcattgaagagctgcacaaggaaatccggctcatagggaacgagagcaaaggcgagcatgtgccaggattctgcctcccgaagaagggagtgacctccatccttccagtgttgcgggaaggagtcctgactggcagccctgagcagaaggaggaggcagccaaagcctta

SEQ ID NO: 1666 - DNA, 216 bp, Homo sapiens
ttataactctggattaccgatgctgagatgtgtgcaggaatacttccaaataaatttttaacattgtaagccagtagattctttggctgggtggcaaattttgagtcttcttgcatatttggctcatgggttcataaattgaggccagagactcattgtatatccttgatcaattttctaattaaaggaaatagcttattgtttagtaaaatggcc

SEQ ID NO: 1667 - DNA, 300 bp, Homo sapiens
ccggattagaagcagtcagcctgaatgtatactgtgtgcttcttttgagatttttcacagtacaggttaaatcctctccagtgtattttgggtggaaaaggttatcattttcatcctcctgaatttccaaggtgtaggtgatcacttcctcgggtgaacagccttctggcttactccactgcaacgtgacccatgtgatgccagctcgaaccagccttggtgcagaaggcatctgagggatatttcctaatgtgtagcacaccacctcttggctataaccactggtaccaatgtcgtttc

SEQ ID NO: 1668 - DNA, 180 bp, Homo sapiens
acacctggccttggagtcgcttttaaatctcttttacacatcctgtattccagtccgtaaataaacaaatattttttgctttctccatagtatatccagattcattcaggccacaacaatctttcatttgatgtactcaagtaagttcccaactggtttttctacttcccatgcttactc

SEQ ID NO: 1669 - DNA, 110 bp, Homo sapiens
gatggatatctttgtcagtacatataattctatttggttctctttaatggtcacatagtaagacttattatattagggtcagcaaagtatggcctctagaccaaatatgg

SEQ ID NO: 1670 - DNA, 193 bp, Homo sapiens
gattccattaatacaaagtcctagaacaggtaaaaccagatggtagtgatagaaatcagaggcatcagggttagagttgactgcaaaagggcatgagggagctctttgggtgagggaatgttctttgaggtgatgattgaagcgatggttacataggcatatacatgtgctccaaactcatcagtctgtacat

SEQ ID NO: 1671 - DNA, 268 bp, Homo sapiens
ttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggc

SEQ ID NO: 1672 - DNA, 221 bp, Homo sapiens
  misc_feature (57)..(131): n is a, c, g, or t
aatcctcccgtctctccaaaaccatctccccgtcccctgacattgcggcgctctgannnnnnnnnnnnnnnnnnnnnnnnnnnnnnnnnnnnnnnnnnnnnnnnnnnnnnnnnnnnnnnnnnnnnnnnnnngagagagctttttggcgcgcgcctttcccctggcgcttttctccccgggaggattgttctccacttttcgcccgtcatagcctaaatccg

SEQ ID NO: 1673 - DNA, 300 bp, Homo sapiens
gccagttcttttacaacgtatgcttcttccttagaatctatttcttttaatctatgacttattctcttcttggacgaaggctatatctgtgttgctatgtaactgcttgacttgtgacaaaactgaatttatcctgtgtatttatatgaggtgcgtcatttctcatcaatatgactcaggcatccccattaaatctgactagatgctatttcacaaatggcttcagaatcagcggagtcaatttaacttccacttccctccttgcttccttaatgtcggcctgatggtagcaagactgcg

SEQ ID NO: 1674 - DNA, 240 bp, Homo sapiens
gggttgctctggcttgtacgctttccggaatctcgagggtccgtcagggctgaagacctgcccaggcacacaactcaccacggccggtagcccattctcgcaggtgacattcttcatggggtccagtgacacctgggggcccagcttgcagctggagatgtgggcctctgtgccggtgcagtccatggagaatggccagtagcgctgcttcctccgtgaagcacacattttgtacacttt

SEQ ID NO: 1675 - DNA, 294 bp, Homo sapiens
ttcatctgaatcatgctcactctctttactcatttccagctcatgtttaagtggcactctgttatagtcatatgggatgacattagaattcctgtttttacttttattttcttcttgatttccaatgtgctgtgtcctccagctcctatatgaaggaagtctctggaattcagcctctagtggagacggctcactgggtggatcccttttcttcatgttatgtagatatggatgtaattcagacaaattcacttctgtttctccaaactgattgtattccaccaaagcctgagt

SEQ ID NO: 1676 - DNA, 189 bp, Homo sapiens
taaacatgcaaactcactaccaaattggcttatagtaatattaggccttagcaattccattaaattaagagcaactcattattggagaacactttctaagttgaactgtaatcatacaaaccgcacagccaagcaagtaacttaaagacattgttgttaaaatagtccattttggattacctatctaaa

SEQ ID NO: 1677 - DNA, 241 bp, Homo sapiens
tgaaaagtagcagcttctctatccaggatgatgagtcaacaggtttcactaatatttgtcatgctgtagcatttgtaagatttgtaaatgatgaaattcaaagaaaactttttctattgctaggagcctgccagaacaaaggccaatatataatgttgtgacatcatatctgataaccagaggtctggtatctacactcctggtgccccatcagtggttgtctccataagtcattttgcgt

SEQ ID NO: 1678 - DNA, 287 bp, Homo sapiens
aaaatctcccttccaatgccaggaaatctcctctaacataatgaatttcccaccccaccactatcccttacatttctttaaattcaagatcacttttcttcttaaaaagtaatcagagaatttataaactaagggtccttagaccaaaccccaaaattatgaacaagaactcaatcattaagtatttgtacattcacctcagtcctgaagaatagccaacctgccactatacactcaaaccaccgtgctatgtgctgagatttgggcttgccaaccatctccgggat

SEQ ID NO: 1679 - DNA, 235 bp, Homo sapiens
ggaggtggacctggcttgcacacccaccgacgtgcgggacgtggacatctgagggcgccaggcaggcgggcgccaccgccacccgcagcgagggcggagccggccccaggtgctcccctgacagtccctcctctccggagcattttgataccagaagggaaagcttcattctccttgttgttggttgttttttcctttgctctttcccccttccatctctgacttaagcaaaaga

SEQ ID NO: 1680 - DNA, 296 bp, Homo sapiens
  misc_feature (241)..(250): n is a, c, g, or t
aaactaggtgctgcagcccctgggaccaggcacccccagaatgacctggccgcagtgaggcggattgagaaggagctcccaggaggggcttctgggcagactctggtcaagaagcatcgtgtctggcgttgtggggatgaactttttgttttgtttcttccttttttagttcttcaaagatagggagggaagggggaacatgagcctttgttgctatcaatccaagaacttatttgtacannnnnnnnnncaataaaacttttcccacccccctcacacctcttctccctagaata

SEQ ID NO: 1681 - DNA, 241 bp, Homo sapiens
  misc_feature (111)..(163): n is a, c, g, or t
ctatacaaatgtcccatggctaccccctaccactattaagtaaatcccagcctcgccctccggtactaatacaccacctaaaaccactcttggtggcactgcgcttcagannnnnnnnnnnnnnnnnnnnnnnnnnnnnnnnnnnnnnnnnnnnnnnnnnnnnaattttccacagtcctctgacgcccgacccctggctcctggtgcaacccgtccacctggtgaacgttcattctttcgc

SEQ ID NO: 1682 - DNA, 250 bp, Homo sapiens
  misc_feature (120)..(172): n is a, c, g, or t
ttcctttccctatacaaatgtcccatggctaccccctaccactattaagtaaatcccagcctcgccctccggtactaatacaccacctaaaaccactcttggtggcactgcgcttcagannnnnnnnnnnnnnnnnnnnnnnnnnnnnnnnnnnnnnnnnnnnnnnnnnnnnaattttccacagtcctctgacgcccgacccctggctcctggtgcaacccgtccacctggtgaacgttcattctttcgc

SEQ ID NO: 1683 - DNA, 276 bp, Homo sapiens
  misc_feature (246)..(246): n is a, c, g, or t
cacagagttcttgaaacccacgattcttcttcaaatccagatgtgtgtgagccccacctcatcaactctgaaggctgaaggatcagctggaatttctgctgcagggtgtccctgataagctcaaaagcatcagaacggagggagctttctccccttctctcatctcattaaaatgagctttcttgttgtggggggttggggagggacctttaaaaccaaacaatggtgccctcttatcatcttttnctgtcctcctttctccaagtttccagaggg

SEQ ID NO: 1684 - DNA, 143 bp, Homo sapiens
aaatcagcacattcctcctacttccctttcctccactccccccatatctttaaagtgtggaagcagaaaggacctgcattttcctacattgaggagctgacataggggtaaggtatgggagaggtaggtggatccagggaaaa

SEQ ID NO: 1685 - DNA, 74 bp, Homo sapiens
aaaagccagagttccatgtttgtactccttgtgctggactgtttcctgagtaccagcaggtccctttttgtctc

SEQ ID NO: 1686 - DNA, 268 bp, Homo sapiens
aaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaagagaccactcaacccccacctggaaggggcaaagaaaagccagagttccatgtttgtactccttgtgctggactgtttcctgagtaccagcaggtccctttttgt

SEQ ID NO: 1687 - DNA, 101 bp, Homo sapiens
gatagaccatctaaagcaccaagtttctggtataaaatagatccatcccatactcaaggctacagaactgtacaactcgtgtgggagacattgcctccttt

SEQ ID NO: 1688 - DNA, 199 bp, Homo sapiens
atatgtgtataggattcgctgtatgaaggaagatggtaagggatactggagtgactggagtgaagaagcaagtgggatcacctatgaagatagaccatctaaagcaccaagtttctggtataaaatagatccatcccatactcaaggctacagaactgtacaactcgtgtgggagacattgcctccttttgaagccaat

SEQ ID NO: 1689 - DNA, 281 bp, Homo sapiens
ttttagaattctggttatcatcggggaaatcaaaaggctgtgcatgggagttagagatggtgcttcccgcctgccccattcgattttgttctgcactgtaattagcccagttttgctcacttgcttgcttgttgtaattgcggcaagaagaattgtttctgtcgccagtaaccagcttgtacccaggaggagacataggcgagaggggagcggttggtgaggagcagccattgaaataagcatatttttgagacccacagtctttggcagggctcagcgca

SEQ ID NO: 1690 - DNA, 145 bp, Homo sapiens
cctgtcactggcatcaacaaaaggaattataccatgagaccttatagctgtacttaaaagccattcagttcagctattgggagttcatgatgaattagcatatgccagaaaggttgctaaccttaacatctgagagcagtaacac

SEQ ID NO: 1691 - DNA, 278 bp, Homo sapiens
gaattgccatatacggccagttaaaactgctgccggacagtaacatatcccggatgagggtttcgatgggggttttacctaccaaacggacgaaaaacaattgctctatgactgaggaggagacggtgcggagggaagggaggcgaagcaaaagctttccgaatctcgtcggctggttggggtactggctcctaacgtattcttccaaagcacactgagacttttcctgcaagctttccacatgggctacatcagagagaccacaggcatctggaaga

SEQ ID NO: 1692 - DNA, 257 bp, Homo sapiens
aacccactggtgcaagtcctagattccaaaggctgaagaacctggagtctgatgtccaagagcaggaagagtggaagaaagccagaagactcagcaaacaaggtagacagtgtctaccaccacagtggccataccaaagaggctaccgattccttcctgctacctggatccctgaagttgccctggtctctgcaccttctaaacctagttcttaagagctttccattacatgagctgtctcaaagccctccaataaa

SEQ ID NO: 1693 - DNA, 198 bp, Homo sapiens
gagctatagtacatgtgtgttatgaatgaaatatgacagcatgttccatacccctgctttagccatctgtgggaaaccagcaaactgaaaaagacacctctgcaaaatgtgcctcaagtccatttcttgggatcgctcgtttggtgcactctcgtgggagacaatcagagaacaacatatacttgtgccttattttca

SEQ ID NO: 1694 - DNA, 197 bp, Homo sapiens
aggaccatttaagtctgggccacttaatggctgccagcattcctaagattacacttttccccatttatgtccaatcagaaaaagaaggcatctttgtaccagaaatctcagcaaaagccctaatattcacactgattaggcctgggtcacatgtccaccctgaccaatcactgtggccaggaggatgatacatgcta

SEQ ID NO: 1695 - DNA, 292 bp, Homo sapiens
ggataactgctctatatgtggagaacattagaacaaagggacctgaagttatatttcagtgtcttagcgaggatttcaggaactgcttggtatgaagagttgtgtcagggtgagtctgttgtacttccccagctagaacaagtcatctttcatcattttcatatgtttggctttgtttctgtaggtctctatcccttagtcttcatactgttttaaatgcttatttacttatccttattccccatttaggctctaagcactaagtgggtactgcaagtgctcaaaaattttg

SEQ ID NO: 1696 - DNA, 193 bp, Homo sapiens
ggaggaatagatgactttctttcttttggtgggggttgggacttgtggctttaaagaaatcacttctgagtaggatgtatattttcgttggatttttgttgttatttctttagaaccctccacagcaacatgcaagaccatggagttaaagaaacccagagacctttatcaattaattgtactgtttgtgaat

SEQ ID NO: 1697 - DNA, 278 bp, Homo sapiens
aatagacaacttgattctcctcttcatcctgttgtcttcaggctaggagactaggagatgctcagccagccaaggatgtcccatgggtctctacctggccaccctgagaggtctctatgctggcctcacccaagaggtctctatcctggccacactggggaggtctctatcctggacaccctagtcctccactgtaccctgcatccacaggtccctggatggacttggatgagttggctcttccccttttctcagaataactgtaggcctgtggttac

SEQ ID NO: 1698 - DNA, 277 bp, Homo sapiens
gaaggaccgagatcgagacaaggatgggcacagacgggacaaggaccgtaaacgatccagcttatctcctggtcgaggaaaagactttaaatctcggaaggacagagactctaagaaggatgaagaggatgaacatggtgataagaagcctaaggcccagccattatccctggaggagcttctggccaagaaaaaggctgaggaagaagctgaggctaagcccaagttcctctctaaagcagaacgagaggctgaagctctaaagcgacggcagcag

SEQ ID NO: 1699 - DNA, 65 bp, Homo sapiens
tgtactccagctagcacaggcagacgtgtaagagacttttgcactttatgtacccatcctgaggc

SEQ ID NO: 1700 - DNA, 103 bp, Homo sapiens
tgtactccagctagcacaggcagacgtgtaagagacttttgcactttatgtacccatcctgaggccttttcccctctctcatccttttgccatgtcctgtggt

SEQ ID NO: 1701 - DNA, 281 bp, Homo sapiens
ggtattcccagagccggatgacattgtccttcctcgctgtgatgcgcttgatgtcgtggtaattatcggcctcgagctaactggccacggctaccacagcctgcacacgctcctcgtatgcggcaatgtctgtctcaatggcctcgtgcttttttgtggcggactcaactgcaggaaggtcaaacccaaagttgtcctgagacaccagacgctgcttttcgctcagccaagtctccctcatagctgcattgcgatcaaatctgcgggcgagctgttccagt

SEQ ID NO: 1702 - DNA, 203 bp, Homo sapiens
tagcggcaagtcttccgtgtgtgctaagatcgtgcagctcctggggcagaatgaggtggactatcgccagaagcaggtggtcatcctgagccaggatagcttctaccgtgtccttacctcggagcagaaggccaaagcccggaagggccagttcaactttgaccacccggatgcctttgacaatgaactcattctcaaaacac

SEQ ID NO: 1703 - DNA, 249 bp, Homo sapiens
aaaatactacgttctagctgcttaaacagtctgtattttccacattatgatggattcaaagcaaataagagtcacacttcaaagtcagaagttgcattcctcttaaaggatatttgtactcggctgctactataagacaaaggttaacttgacaggctcaatgtctctgttatatattgtggaaaaattacctaaaatagctatcatttattaaatttctattttctgttaggtgctttacaaatgcca

SEQ ID NO: 1704 - DNA, 281 bp, Homo sapiens
  misc_feature (30)..(56): n is a, c, g, or t
atccacacagaagtgcggacaccgtttttnnnnnnnnnnnnnnnnnnnnnnnnnnntccgagtggcccacgccctttggtggggccccctggagaatggggcaaacacccccggatatatgtaccgcgtgtcccccctcacccccacctacggtgtgggccaatttggcaccccattctccaaaaacgggctccaacgcgcaccgcaaaaaacccgccaatctgtgatgatagaactttcggtctctaaaagaatcccaccaattataccgagggaccttg

SEQ ID NO: 1705 - DNA, 284 bp, Homo sapiens
gtgtttgacaccgagaatttgcttcagaggagctcgaagtttcatctttcttctcttcttcttctttatcattgttctctccccccgtttcagtccctgcttccctatcactgtctgtatcctttgattccagcacattaatggtgggggtgctgggcctgctactgttattgggaagccgtcctcttctgcggcctcctggacgttttggtggggtctttatccgctcagcggtgagagcagcagcaaactcctttgctccctccaaatgctggtaacactgt

SEQ ID NO: 1706 - DNA, 293 bp, Homo sapiens
tttgtgtcccacattcaaatcctctctagtaatttctgcaaaggttgagaaggctggcatgatggagagaacggtaaccatgaggaaagcttcttggagtaaagcactcctctctccaatgcagagggtaaaactattaacatataagcaaaagaaacttgggctaactgagacccttaaaggagttcccctttagtccaataaaaggccaacttcaaatctttacaccagataaggtagtcaagatcatatcatatacccagagaatgactgcttgtatggacatttcctac

SEQ ID NO: 1707 - DNA, 201 bp, Homo sapiens
tgtttactaacatatattgaccaagtacatcaagcaggagagatcttccttcattctgttatagtccacatcattctaattttgctcagttgttattaagagcatattcctaaaccatacacttttgtttcaataaagttttattttgttgagatgaataaaataacaaagttataagctgcataagacaaaagttcaatt

SEQ ID NO: 1708 - DNA, 91 bp, Homo sapiens
aatccaacattgacaagaagttctctgcgcactacgacgcggtggaggcagagctcaagtccagcaccgtgggtctcgtgaccctgaatga

SEQ ID NO: 1709 - DNA, 85 bp, Homo sapiens
gaagaagtggtcaaccacagagtcttcaagaaataagaaattctgtaccatctgaaagtagttcttgttggtgccttcatttaaa

SEQ ID NO: 1710 - DNA, 152 bp, Homo sapiens
atgctgttcgcttcatccctcatgagaatggtgtccacaccatcgatgtcaagttcaatgggagccacgtggttggaagccccttcaaagtgcgcgttggggagcctggacaagcggggaaccctgccctggtgtccgcctatggcacggga

SEQ ID NO: 1711 - DNA, 273 bp, Homo sapiens
  misc_feature (227)..(227): n is a, c, g, or t
aatgaagtgtcttggccaatggcttctctaattattgttctgaaactttgtggttatgtaatcttccgaggtgcaaattctcagaaaaatgcattccggaaaaatcccagtgatccaaagcttgcacatttaaaaaccattcatacttcaacgggaaaaaatcttctagtttctggatggtggggctttgttcgccaccccaattacttgggtgatctcatcatggncttggcgtggtccctcccatgtggttttaaccacattctgccttat

SEQ ID NO: 1712 - DNA, 285 bp, Homo sapiens
ttagcaaaaccctcaaacaccagtgacccaggaggggacaggcaggggacgatggcagaagcactcacttccgaggcagagacctggcctgggtgttgaagcatcattttgctccaggctccgctcggggcggccagggtcgggacggggtcgggcgggctgtttgtctggccggcgggcgagcacacgaggactcacggccggcgcgcgggctgaagggtgcgctcgggcggcggcgagagaagagagctgtgcagtgcgcgcctggctgcgatcccgggaatt

SEQ ID NO: 1713 - DNA, 289 bp, Homo sapiens
caactacagaacctcctttgatcaggccagtaggttgtgatgcaggctggagcccccgaatgccccacacacactgcagcattgaccagaccatccgaaacctgcgtccctggtgatgttctcaagcctcggaagtggcaaatggaaatgatatggccggttgcggttgtaggagagttgtgacttaggcaggagtcgacctcctcaagtaatggaacgatttcaaaggcaggctgccctgaccaaaaatatctgccatgaataaaggtgcctgaaatcctgctatgaa

SEQ ID NO: 1714 - DNA, 126 bp, Homo sapiens
aaacatcaaatattcccaggaaattggttttattggagaactccagaaccaagcagagaaggaagggacccatgacagcattagcatttgacaatcacacatgcagtggttctctgactgtaaaac

SEQ ID NO: 1715 - DNA, 287 bp, Homo sapiens
cccctctgccagacagtgggttgaacacacatgtacacctgaggaggagggtctgacgagggctgcctcagagtcagaggcagcaggactagctctgtatgttcgacctcatgtctggcccatcttgagtcccaggctcatacaaaatcacctgtgttcagatacagattcaactcagtatttaatgagccaagcactacttgaagcatcttgacagtccttctcttcacataagccccgacaatcacatctgcaaggtacgtatcaagtccctacgttccgagaca

SEQ ID NO: 1716 - DNA, 244 bp, Homo sapiens
cacacagactgtggcagaactgcgccccatcccgcagaggccccctgtccacctggagacccggagacagaggcctggacaaggagtgaacacgggaactgtcaccactggaaaggcgtgaagcctcccaacagtgccgcagcgtttcgaggggcgtgtgctggaccccaccactgtgggttgcaggcccaatgcagaagagtattaagaaagatgctcaagtcccatggcacagagcaaggcg

SEQ ID NO: 1717 - DNA, 198 bp, Homo sapiens
agcattgacagcaatactgcttgtggtatctgaacttcaatacaacatgtctgttatggacttgcatttgaagccatcacatttatagagtatctgacttcttcattacttctttaaataacttcctaagcatctgtatcttgaaaggcatattatcacatattgttttcatttgtcctttacatttgagcattttac

SEQ ID NO: 1718 - DNA, 171 bp, Homo sapiens
actcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttccgagaccaagaaatta

SEQ ID NO: 1719 - DNA, 279 bp, Homo sapiens
tcgagagcaggccatttcccaagaagatgaagaatggtgactgtgtttttattgaaggaatttcaaatgaagaataatgtttaaaatgtgtatatagagatagtatagactcctccgcggaagcatggagggaaaggaggttgtaaaatagactccatggagactcttaggaagcagtagattcccgggggctgtgcctttagcgttagaggaaacacatagagctggaactgttaatggaaagcagtcacagctgagttttccgagaccaagaaatta

SEQ ID NO: 1720 - DNA, 35 bp, Homo sapiens
gaatctccaaagagaatagccggcccgaaaaggag

SEQ ID NO: 1721 - DNA, 261 bp, Homo sapiens
gctgctcaggcagagtacatcgagaagtttgccaaccctttccctgcagcagtgcgagggtttgtggatgacatcatccaaccttcttccacacgtgcccgaatctgctgtgacctggatgtcttggccagcaagaaggtacaacgtccttggagaaaacatgcaaatattccattgtaaacaaatcaaaggaaaagaaaccaagaactgaattactgtctgcccattcacatcccattcctgccttttgcaatcatgaaa

SEQ ID NO: 1722 - DNA, 298 bp, Homo sapiens
  misc_feature (79)..(79): n is a, c, g, or t
  misc_feature (213)..(213): n is a, c, g, or t
  misc_feature (234)..(234): n is a, c, g, or t
  misc_feature (265)..(265): n is a, c, g, or t
  misc_feature (267)..(267): n is a, c, g, or t
agaccggcaatttatgaggagtagtaggcgcacggtacgcatcgctcgtacccatgtgacgcaaggtcgacgcggcctnacttactaggtgactgacagcgggatgggtgtgtcgtcacccggtccgcgccccaccacgcccatggtgatatgacgtttcactatagtcctagacagacgtactcgtatttgcccacgggtctctgatgctanacacccacgctgttgctccancgttattacccataccacaagaatgacgagncncccctctattttattacacagcgacgccacg

SEQ ID NO: 1723 - DNA, 285 bp, Homo sapiens
agaagaaatcccagtcgtgcctttaactcttttggcccttgggagtcattgcaaccccaatacaaatgccggcccagggatttccagtggccacaagttattgcacagagaggtctgttctaagccagactcttacagctaaggaggtgtgagattagcccttaaatactggtctagcattagcatggtctataaaagcatgttaagaaatagctcctcagtgattatgtaccagctactagttatcctactaagagaaaaggcaacatggcagcttcacatttc

SEQ ID NO: 1724 - DNA, 195 bp, Homo sapiens
ttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacattttttaggtctcttaaactttaatttcacaca

SEQ ID NO: 1725 - DNA, 35 bp, Homo sapiens
ccacttctaatgcaatacatatcccggagtgtgct

SEQ ID NO: 1726 - DNA, 221 bp, Homo sapiens
gcactaccaggatgttttataccatgctaaatcacagaaactcggagactctgagagtgtttccaaagtgctttggctggatgagatacagcaagccgtcgatgaggccaacgtggacgaggacagagcaaaacaatgggttactctggtggttgatgttaatcagtgtttggaaggaaaaaaatcaagtgatattttgtctgtattgaagtcttccactt

SEQ ID NO: 1727 - DNA, 206 bp, Homo sapiens
  misc_feature (108)..(131): n is a, c, g, or t
ttcacattgtttgctgctatgtggaggatcagtgttttgtgttacaatgtcatatactgccatgtactagttttagttttctcttagaacattgtattacagatgccnnnnnnnnnnnnnnnnnnnnnnnnatgtgatcaattttgacttaatgtgattactgctctattccaaaaaggttgctgtttcacaatacctcatgcttc

SEQ ID NO: 1728 - DNA, 267 bp, Homo sapiens
ttaaactccaccaagacccagcaagaagagcctcatggcaggctaggactgagttcttcccagaagacaggtctaaaacacaagcttttccaccttaacaatggatgtctcctgaccccttcctccagaaatcaaatggccaatctgatgcccacttcagcttctgtcatccctctgtagtcagacaaggagggctcgctcagcttgcatttccttcctgaagagtattcactacctctcttgttcaaacactatgtatcactcaat

SEQ ID NO: 1729 - DNA, 298 bp, Homo sapiens
gggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtcct

SEQ ID NO: 1730 - DNA, 270 bp, Homo sapiens
aaattaggtcatgggtctgggatcagattctgtgaagttactgagcttcaggacctgcatgtgtttgtgtgcatgtatgtgtcccctgtgtatgtgtgaatgagagagggaagaaaaagaagaaagagaagctttacttggatatctgcctctattatgaaggactctcaagtaacagccttttgatgtaaagagcagcttccactgtctctgaaactgcagcgagttgacaggtgatgcggctgcatttaggaagcctggaccctctac

SEQ ID NO: 1731 - DNA, 252 bp, Homo sapiens
aataccgaactaatggtccttgtctcaatgacctgcctatcctttgtcccttcatgggaatcttctcacagatcaagttactatgatctacaaggccagttcccatagcctcgttccacttacacacgatcttaaccatttctgtccagtgggagtcacccactcacctcctaaaacctctatgcatgccccatacccctagtcataatactcttatacaaatgtttaacactttgcagttgaagacccaat

SEQ ID NO: 1732 - DNA, 283 bp, Homo sapiens
aatgttttaagacggctccctccagttacccggtaggaagactttctggccgaaaattctttgaaaaaatacttggaaaaaggtccctctcgccccccgcttttaaactggtgggaggagtcccccaaaccccctggtgaaacgatcctctagccattaaaacgttcatttcttctgaaaacttcacctggccggcccattatttgccaataacctcttaagagtggtgaatcttttgggcacccagggagcggggaataaattgtgaaggaccgcctcgcgg

SEQ ID NO: 1733 - DNA, 275 bp, Homo sapiens
ccagctggagtttttgggacgcttttgtgggggcaccgctgagtccggatagtgggacccaagtcgtcctgctcggcccctggggaataatcgtgtggggcgcaaggtctgtgggaagggacttggagaggagggaagatgtcgcgggagtctgcacagggtttccatgtgttccaattcttcgtcccataattcaaagctcgtggcattctgtggccgaccgctaccgagctagctcttccctttactatttcgcacttggtcttggaaaagat

SEQ ID NO: 1734 - DNA, 281 bp, Homo sapiens
  misc_feature (51)..(59): n is a, c, g, or t
gaaaaacccttgtgggcaccaatgaaatagagggggcttcgggagattttnnnnnnnnnaacataaaaaaagaacacgcccccccgcggggggcgaaaacgcccaagggcggctttttctcagtaaaacaaaactccccccaaaacgtgggaagttttctctctcgggagggcccttatttgacccgggggcgttctctatccccaaccacgtgggcggaggctcccctaaggagagcgcgcgtcctctcgataaatattgcgcgacgacgtgtttcagcg

SEQ ID NO: 1735 - DNA, 259 bp, Homo sapiens
gggatgtaacctggctgaggtgggaacctgcacccgacttttgacaaccatccctcatggccggtccacctgcctttgaagaagaccttgaacaaggtggcaggggtggccccacaaggcaagtttcaggaactttttcaaaatccaaggggcaaaaaggggccccttaacgttcctggccacggtttcgggaacggcaaaccttctcccacacttgggggagagacctcccttgaacgcccccgctctaaagaagaca

SEQ ID NO: 1736 - DNA, 35 bp, Homo sapiens
cgttaaagggaacacgagtatctctgcgaccggtc

SEQ ID NO: 1737 - DNA, 197 bp, Homo sapiens
aggtggtgtcactggctcaccagaagcatcaatttctgggtccaaaggtgacctgaaaagttcaaaggccagcctgggctctctggaaggagaggcatgaggccgaagcctcttcaccgaaaggcaaattctcctgatttaaaagtaagaagccacggcaccgctcaaattcattcagtgatgaaagagagttctct

SEQ ID NO: 1738 - DNA, 149 bp, Homo sapiens
acgtataatgtatgtctggtgtttttaacttgatcatgatcagctctgaggtgcaacttcttcacatactgtacatacctgtgaccactcttgggagtgctgcagtctttaatcatgctgtttaaactgttgtggcacaagttctcttg

SEQ ID NO: 1739 - DNA, 243 bp, Homo sapiens
cacgggttcttatatgaagatacacttataatctggtatgttacctggtcaagaggaaattcaatatacaagacaggcatgaaccttggagcacttcttcctgacagtataagtgaacttaaaaggacgtcaagtgccaataggaacttacatacaagcagccagagtacagtcccatatgggagataacacgaaatcactaatccttcttcttttctttgcttttgctatcatagtctcgaa

SEQ ID NO: 1740 - DNA, 225 bp, Homo sapiens
cagaggtgtgaaggctcgccatagaggagggcttgttgagtgtcactcctggagcctacggagtcgcagggaggcctggcatggtcaggtagacttggtaaggcctgactgctggggaatgtatcctgccaatagattcctgggcctggaacagctcttctttggacacatgccatccatctttggaataagacaatctggcatttatgtacctggtgggttacc

SEQ ID NO: 1741 - DNA, 227 bp, Homo sapiens
agctcctggctttgtatatgcctggcttgaactgatttcccatcggatatttattgcaagaatgctggcacatacgccacagcagaaggggtggcctatgtatgcacagctactgattgatcttattcaaatatttagcgcctttccttagaaatgtggaactcaccaaacctatgcaaatcctctacaagggcacttcaagagtgctgctggttcttttgcatgat

SEQ ID NO: 1742 - DNA, 256 bp, Homo sapiens
atcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaagcgaggggactatgatgccaacat

SEQ ID NO: 1743 - DNA, 247 bp, Homo sapiens
tgggacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaaccaa

SEQ ID NO: 1744 - DNA, 244 bp, Homo sapiens
gacaagtacacgatccgctgagcatccaggaggctgcgcggccccggctcctcagctccctcagtgtgccccgtggtgtcaccgggactccaggcacccgctcccctgcgaccatgccaggcacgctgggaggaggacggcagctgctcgtgtcctgcccctgccacatcagtgactgctttattcttttccaataaagaagtgcacgtgtcagagctggagcgcctgcattgtgagaaaccaa

SEQ ID NO: 1745 - DNA, 288 bp, Homo sapiens
gggctattgagagtcagcaccagcactgatcatatataggatcagcctactggggttggccacgttgtatgtagctgcgaatagcaaggaggggaacagcaacatccctagggaaaccgatcacagaaaggcagctcactaccccacagtaaaaagaaccttgagtttcccagttcagtcccctgctgggtgcatgctacccccctcctctcccagaggctctggacctacacagctgctgaaaaagagaaaatgtccttacctacaatgaaccatcacaggcaccca

SEQ ID NO: 1746 - DNA, 201 bp, Homo sapiens
gttgcaattgtctctcactgacgtatttgaaggatatttgagctggaaagctcaaccaaatgatgcgtttttgctaatatgatgacttctccatagacttctttagatttatatatgttcctgtgcacttatcaaccttctcatagtgcctcctggcttatcatggcttttgaaagaatagaggatctttgtcactttgac

SEQ ID NO: 1747 - DNA, 238 bp, Homo sapiens
aagagctgcgtcacagccagagggacaaagtgtgggtgatcctggagacgccagtttccgagattgttctgcatattcatttgcacattgttgtctgggttggacatgcgtgtgggcttcagtgtgaggcttttaatatgtatatcctgttatcaataaaacaattatccaagtggttgaatcctgtgagacttggcaagtgtgtgcaaatcaagtatacttgacttttcaacctctt

SEQ ID NO: 1748 - DNA, 112 bp, Homo sapiens
cttggctctcagttttctcagagtgaacatgcctcgtagcttgggtcctatggcaggagtgcaataggacatggatatgcatcacctgttctataaaactggttgctggctg

SEQ ID NO: 1749 - DNA, 252 bp, Homo sapiens
aagagcctctccctggagagcactgaccgcgggagctgggacccgtgagctgcctcagcactgggacctctcgctctccgctccctgccactcgcctcctctcactttcatctcttccctccacctcgcctgctcggcctgaaagccaccaggggctggcagcagtagcaggacagggattcaggagttctgacgacacgactctcagatccacgcccccagcctaacagcaacaacaaagacagactttcc

SEQ ID NO: 1750 - DNA, 268 bp, Homo sapiens
ggacctaaaggtgatccaggtataagtggaaccccaggtgctccaggacttccgggaccaaaaggatctgttggtggaatgggcttgccaggaacacctggagagaaaggtgtgcctggcatccctggcccacaaggttcacctggcttacctggagacaaaggtgcaaaaggagagaaagggcaggcaggcccacctggcataggcatcccagggctgcgaggtgaaaagggagatcaagggatagcgggtttcccaggaagccctg

SEQ ID NO: 1751 - DNA, 185 bp, Homo sapiens
agatgcagtcaaagtcttttcagacatgcccaaactttgagaatttcttcaaccatctaatgctataaagatttttgttcttcctgttcacaaccagttgtataacagaaatactagctactgttttccttcctgtgtgtgaagtaatgaatcattgattatgtgacttgttatgtattcaatta

SEQ ID NO: 1752 - DNA, 272 bp, Homo sapiens
accaagtagctgtgggttgaacctggacgtgagctggttgcagggccgttgggtagaaaaccagcatctcataaacaggtcactacaaaaataggaagagtataaaaatagaatatattatgtcactatttcgtcttctctttatagtagcgtatcgtaggagtgggacaaggtggcctttcccgacactgctacgctggtctgtgcccgacaaacctcacctgatgttgtacctgagtacgttactaaatcctcaagaccttacacacagc

SEQ ID NO: 1753 - DNA, 268 bp, Homo sapiens
gaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaa

SEQ ID NO: 1754 - DNA, 261 bp, Homo sapiens
aggccacagggttcccctctaagctgcagctccgctcctctgggttgaacatggcggggaagatggtgagggaggcactagcggacacgatggggcggcccctgtataccacagccttgtccacaccaaaggaccccacaatcagatcaggatatccattgccatccaggtctcggcctcctcgaagggcagagccaaagaagtctggggtgtggctggctgcccacaggggctgcagaacctgggaaggcttagagccca

SEQ ID NO: 1755 - DNA, 269 bp, Homo sapiens
gttgatgcaggccacagggttcccctctaagctgcagctccgctcctctgggttgaacatggcggggaagatggtgagggaggcactagcggacacgatggggcggcccctgtataccacagccttgtccacaccaaaggaccccacaatcagatcaggatatccattgccatccaggtctcggcctcctcgaagggcagagccaaagaagtctggggtgtggctggctgcccacaggggctgcagaacctgggaaggcttagagccca

SEQ ID NO: 1756 - DNA, 284 bp, Homo sapiens
agtgggatggctctcttccctcagccacgccgcttgtgaggacagaggtgggggagtgggaagtgggaagtcaccagagaacaggagagggatttgagggcgcgaccccagcgctctccacggaccagccagagggactggagccaggtgtgcatgggttcaaggccctggccctgcccagcctctgtcttgggagctcagccccagggttcggtcgtcagcagtttcccaagaacaagatgtgatggcatctgctgctgaaaccctgatgaggaccaggcccc

SEQ ID NO: 1757 - DNA, 77 bp, Homo sapiens
agtctgcctatgatctttgaatgagctttttaaggaagaatattatatattgtttgctaaagcctattgaaataaag

SEQ ID NO: 1758 - DNA, 237 bp, Homo sapiens
ccatcccaccacatcatgtaaagtgtttctaggcttctctatataatacccagaaatgtgagcatacaaaaagtacaaggatgtgaaggttatcaaccagagagcaaattggtcaatgaggcaaatcatcacatatgtaaagaaaacagtcttcctggcataactccagagaacacacacacacatatacccatgcacacacccacagcaacaaatgtgtctggtctggtaagttta

SEQ ID NO: 1759 - DNA, 270 bp, Homo sapiens
gatacctcagccattagcaagctctgtcagtttttttcttttcttatgcctgtcttattctttctctcttggtttatgcttcagagcacttgaaaaaccagtatcactaaaatctaatttttgtcaaattatcttcaaaaattgtatggctctttttattgtattgagtgtcccttaactctcagcattttttgtagtttggcagtagactttctgacattctctcttatttccatatcccagtgaaatcattgttccatttcagctaga

SEQ ID NO: 1760 - DNA, 222 bp, Homo sapiens
gtcctctctatcctggatgagctcatgaacatttctcttgtgttcctgactccttcccaatgaacacctctctgccaccccaagctctgctctcctcctctgtgagctctgggcttcccagtttgtttacccgggaaagtacgtctagattgtgtggtttgcctcattgtgctatttgcccactttccttccctgaagaaatatctgtgaaccttctttctg

SEQ ID NO: 1761 - DNA, 273 bp, Homo sapiens
aaaaggactcatggcattattaatataattagtgctttacatgtgttagttatacatattagaagcatatttgcctagtaaggctagtagaaccacatttcccaaagtgtgctccttaaacactcatgccttatgattttctaccaaaagtaaaaagggttgtattaagtcagaggaagatgcctctccattttccctctctttatcagaggttcacatgcctgtctgcacattaaaagctctgggaagacctgttgtaaagggacaagttga

SEQ ID NO: 1762 - DNA, 111 bp, Homo sapiens
gggccatcatcagaatttgcacaggctgctgggaagagccatggctgtctgctgggaactctgctggggcaagcaagccctttgactctcctgcccatctcaagaatattt

SEQ ID NO: 1763 - DNA, 115 bp, Homo sapiens
gggccatcatcagaatttgcacaggctgctgggaagagccatggctgtctgctgggaactctgctggggcaagcaagccctttgactctcctgcccatctcaagaatatttctaa

SEQ ID NO: 1764 - DNA, 280 bp, Homo sapiens
cagtgttaccctgtaaggtgttagccttaaaccaccgagcagcgttctcttgatgccagtgcagagaccagagtcagatgcccgaggacagtgggtaggaatttcatcaacaaatggacctatggcatcatggctttagaagctggtacatttactgagctgatggacagtggccttctaaaatatgacacttaaattgtaaatatgcactgtacttaaggattcttaagatgtatttttttgttatttctcctccagctgctatcccttggctaataaa

SEQ ID NO: 1765 - DNA, 256 bp, Homo sapiens
acatataaaatcatcagtctgcacacgctctaggaggggccaagacatagggacaatccttggtgcaggtttctgctacccctcgctagtttttgccaaagtagcaaaagctgagttaagagaaaaattctgtccatcagaggccatcttcctctcatctgatatgacgtgttcctccagcagggagggagggagagcgggtgccctggggaatcagccatccttagtgacatcctttcggctcatgggtgtcgtg

SEQ ID NO: 1766 - DNA, 296 bp, Homo sapiens
tgctggtgcattagtccttgaccactgtttgatgggaatcctacagcattggggtatcttggtacggactgattcattggagtattatttgtaaggcctaaattttgattcatccctgtattgttaactaatccctgatttaggttactgtaaggatatcgagaatactgccctgagttgtttatagtaggagaggggactgtctggctccgagaactaaagttaagggtttgcggcctaacagccccttgttggggaggattcggggagaatctgggactgtgggcaacggattc

SEQ ID NO: 1767 - DNA, 256 bp, Homo sapiens
ctaaaaccactagccagagcaggagtacataaacagcaaaaataaatcccgcagaaaaggagattctgatttatagagttgacacataatattatttaagacactcagttttcaacaaaaaattatgaggcatgcaaagaaacaagaaaatatagctcacacttagaggggaaaagcaatcccatagaaactgttcctgagcaaacccagatgttggacttacaagaaaaagagttaccaaatggaaagtatcaat

SEQ ID NO: 1768 - DNA, 194 bp, Homo sapiens
atttgttaatcctccgcagctgggatgaacattttcctaaggatggagaagagataatactcactaatacacgagtcagtagttttactttcaggtggcttttaatctgatgtttatctaatatgatgacagctgggggacagagaaatgttccacttctacctatgtatcaaactagatacctaagcccttcc

SEQ ID NO: 1769 - DNA, 300 bp, Homo sapiens
ttaaatgcacctggaatatataaccagtgttgtggatttaacagaaatgtacagcaaggagatttacaactgggggagggtgaagtgaagacaatgacttactgtacatgaaaacacatttttcttagggaaggatacaaaagcatgtgagactggttccatggcctcttcagatctctaacttcaccatattaccacagacatactaaccagcagaaatgccttaccctcatgttcttaattcttagctcattctccttgtgttactaagtttttatggcttttgtgcattatctagat

SEQ ID NO: 1770 - DNA, 266 bp, Homo sapiens
gtatcagtgaggtaacagcaaccagacaaagtgggtgataaaatttgatggcattagatctacagctggagggaactgtagggaagaggaatatgttagataacatgcaaaacccataagattagcaaaacagtttttcctaaagattaaattttatatgctttcactctcaacattaggatacttcagtacaagagtttagatagtaacccaactaaagtaatactgatcgctgaatttcaagtgagctcaaaggtctccttccc

SEQ ID NO: 1771 - DNA, 212 bp, Homo sapiens
cactggcagatgtcccggcgaagagaagagacacattgttggaagaagcagcccatgacagctccccttcctgggactcgccctcatcctcttcctgctccccttcctggggtgcagcctaaaaggacctatgtcctcacaccattgaaaccactagttctgtccccccaggagacctggttgtgtgtgtgtgagtggttgaccttcctcca

SEQ ID NO: 1772 - DNA, 217 bp, Homo sapiens
ttcctttgttgcacaaatagagtttggaaaaagcctgtgaaaggtgtcttctttgacttaatgtctttaaaagtatccagagatactacaatattaacataagaaaagattatatattatttctgaatcgagatgtccatagtcaaatttgtaaatcttattcttttgtaatatttatttatatttatttatgacagtgaacattctgattttacat

SEQ ID NO: 1773 - DNA, 293 bp, Homo sapiens
gctacaccattatggtcctctttgctgaccaggccacgcccaccagccccatccgagtcaaggtggagccctctcatgacgccagtaaggtgaaggccgagggccactggcactcagtcgcactggtgtcgagcttggcaagcccacccacttcacagtaaatgccaaagctgctggcaaaggcaagctggacgtccagttctcaggactcaccaagggggatgcagtgcgagatgtggacatcatcgaccaccatgacaacacctacacagtcaagtacacgcctgtccagt

SEQ ID NO: 1774 - DNA, 282 bp, Homo sapiens
acagatgtcacagccgtgcttattcttcagcaatccaagtggacaatacttgtcacagattatgggtctgcacttcttgggccttgggcggcactcacagatctcacagttttgggcatcagtaaggaaaccgaagggacagttcaaggtgcagccttgtttacgttctgaacatagttcctcggtgtttatgcactcacaggtccgacaaccattgtgatcgcgtttgaaaccattaatgcagtccttccctgtcagagtgcagtttgatacggtcccgac

SEQ ID NO: 1775 - DNA, 231 bp, Homo sapiens
gaaatccagggtgcacctagcctcgcgattgacgacatctttgagaaggagccaaaacatcgtcactgacagcagcagcctcagcgctgaggccatcagacagaggcttgccgacctgaagcagctgtggggtctcctcattgaggagacagagaaacgccacaggcggctggaggaggcgcacagggcccagcagtactactttgacgctgctgaggacgaagcctggat

SEQ ID NO: 1776 - DNA, 291 bp, Homo sapiens
  misc_feature (199)..(199): n is a, c, g, or t
aggcttctgcgggtcccaggattcgcagtctgggcacagacctggagcacagctgtctaccagggctcccagggctttgccgtcttgccagttctggttaaagttggtgatgggcaagtaggggatcttgttctgaatccaccccagcagcctctgctttggcgtctgcttcttggcatcatcatccccttcatcctcncacacggcatggagatggagtagtggagatcagcgccacacagacctagatgagctcagttccatcacaatggcttgctatcgatgacacga

SEQ ID NO: 1777 - DNA, 266 bp, Homo sapiens
atggcttacctcacttcagggaggctgtgagaagcactcagaatctggatgtgccttgggggtgggccccactggactttcctggtggacctggtgtggggtgtgagaggagggtgtgtttggctgcagcagacaggagaatggagttgccactccgcgtgatggggatggctgtgggaggagaggtcctggtggtgagggaatccggatctgagtgctgtaccctggcaagtctgaacgcgcagtgatcgctccactcacgagat

SEQ ID NO: 1778 - DNA, 239 bp, Homo sapiens
gaaggtcaggactttgtgaacatataaaactgcagatggctattagatatccaagtagagatgctgaagagatgaatgtatatagaagtctgaatttgggagagagatctggataggagatacttacctggtgtttaacagcttacagattgtgtaaagtcatgaaacggataagaaccttaaaagagagaaaagggaatagaggttaccaaatgaattgcagtttccaaattgcagag

SEQ ID NO: 1779 - DNA, 252 bp, Homo sapiens
agctgtgacaaccaggagccctgtctgtgggttcgtctgcccagggcctggagcccaagccctgtgttcctggggaagctggggacttgggaagtgatgggtgtgtcatgttgcgtgtgtctgtctgtgagcctttcacacctgtgctggcgctggaaaattatttgtgctcagctgacatttaacactccctcccccgcttcctcctagccctgtgggcaggggttggaaacttagcactttatatttata

SEQ ID NO: 1780 - DNA, 254 bp, Homo sapiens
gagaagtgccctaattgaatgtgtttgaatgttatccttgcacaattctttaaattgaaagataaaatgttttacctcactgttggacatacattccaagcttttcaactctaggagaaaaagaaaatcatgttttcctgtattgtaaattttagactatttcatatacattgtattaaaactgccatatcaattttaatgtatagattttgcaaatattatgctatatgtaatacctaactgtatctgtagtg

SEQ ID NO: 1781 - DNA, 201 bp, Homo sapiens
actgaagtctgttcacagtggcccatggttgggcagcagccctgggtgagctcctgtgttctccagcctctcgctcacccagggcttggctatcctggcctccaggtgctggttcctgaggcttcccttgcggcagtggcgcagatacagggacactcatgtcccattgctcctcagaagtcctagcagcagccagactag

SEQ ID NO: 1782 - DNA, 234 bp, Homo sapiens
  misc_feature (54)..(66): n is a, c, g, or t
cagaagttccagacccggtggaccacctggtgagacccctgtctctttaaaagnnnnnnnnnnnnnggaagacaatttattttaaaaacatctgagaatcattactgcttttataatatttaaattttctacatgaattaaatagccgaagtacatagttatctatcattcatctatccagtaaaatgttatgtatttatgatgcaccagcattataactaactctgagatcag

SEQ ID NO: 1783 - DNA, 249 bp, Homo sapiens
ggataacgtcattagcagaatctcaacttcagacccgtcaacaaattaagaaactggaggagttgcagcaaaaagtttcctacaaaggggaccccattgtacagcaccggccgatgctggaggagagaatcgtggagctgtttagaaacttaatgaaaaggtaatttagcatccttgtccctttccctcatctaaaaaatacctaaaagactcacgtggtagagtgagaggcgggctgacttctggtca

SEQ ID NO: 1784 - DNA, 251 bp, Homo sapiens
aacgacttatgcgaccagattttagaaggtgtacactattttacaacactcgtgactgtagttcatctggcatttgaagcctcaggaatattctggtgaaccagtgaatctccattgggtgacattaccgatcgcagatttgggctacccaagactattgaagaccagtgaagagctcgaggaacatcatgggtaaccctgaatatgtgggtccggacatcctaagttatgatcctcatagccatgccaca

SEQ ID NO: 1785 - DNA, 228 bp, Homo sapiens
caggcggaagcgttggccctccaggccagcctgaggaaggagcagatgcgcatccagtcgctggagaagacagtggagcagaagactaaagagaacgaggagctgaccaggatctgcgacgacctcatctccaagatggagaagatctgacctccacggagccgctgtccccgcccccctgctcccgtctgtctgtcctgtctgattctcttaggtgtcatgttcttt

SEQ ID NO: 1786 - DNA, 52 bp, Homo sapiens
aaaaatgacttacacctttatcaattggttactatttcaatgcaccctttaa

SEQ ID NO: 1787 - DNA, 195 bp, Homo sapiens
tggtgaaggattccaaacctcacttcaccactgtattccagaacagtgtttacaaagtcctagaagttgtaaaagaatgactgctacatgacctgctgcctacggagaactacatctgtaatggttttaatgttttgctaagtcatgtgttgttcatatcccaaaaacttttataggtaactgttttcaaataga

SEQ ID NO: 1788 - DNA, 275 bp, Homo sapiens
tcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaatcccttcggccccagcgaagggtgttgaagagcttgagtccctctgtgaggtgtaccggcagtccctcgagaagctagaaga

SEQ ID NO: 1789 - DNA, 35 bp, Homo sapiens
ctcgggacctgtggtacccaggaatgaaaggagaa

SEQ ID NO: 1790 - DNA, 157 bp, Homo sapiens
acgtaccggcgcaacttcacggcggctgactggggccagagccgcgacgcagaggaggccatcagccagaccatcgacaccatcgtggacatgatcaaaaataacgtggagcaagtgtgctgctccttcgaatgccagcctgcaagaggacctccgg

SEQ ID NO: 1791 - DNA, 181 bp, Homo sapiens
cgggcctcggatccgatcacataggacagtatgcaccttaagatcctgaagaaacggcacaaaatgttcaagtgatgtttagaaataacttgtgagggtgcgtcagggaaatcatgcagccatcaggacacaggctccgggacgtcgagcatcatcctctcctggctgaaaatgacaacta

SEQ ID NO: 1792 - DNA, 276 bp, Homo sapiens
tgctctgcatgctgtagcagtgcacgtcctccttccccttggtggtgtagcctgggagaggctgcccatacttatccacacaccagcagaagccccgcttcctgcctttggaagggcgacactgctttttcttataaaatcccttcttgtcacagttgggaatgtgtacacccctgggactcagcacattgaggaacttcaggtgattcagtgtgtcttccatttctctacggcagggaccatattctgtctcccgcttggactcggaggagaagt

SEQ ID NO: 1793 - DNA, 247 bp, Homo sapiens
gaaagaagccgagagtctaccattcatacagctcatcaattcctcatggacacgatcttccagccctttttaaaagatgtcaatgagctaagacaggagctggagagacagctggaaatgtggcagccacgtgaatctggaaacccagaggaggagaaggttggagctgagatgtggcagagttacctgatcttaacagcgcctctttcaaaacggttatgtgaagagcttcgtctcatattagagc

SEQ ID NO: 1794 - DNA, 250 bp, Homo sapiens
gtctgtctggataaaagcgtggcatcaccataatcttccatggcagatttcgcacaaaacacggagggctaaggaccgactcactcagtctgctgaagcgctccacagtgaactgaaaggctgcctcggagcgccaactggtgtcatcctccatgtcctcctccgcggtgttgtgtccatcactcagggccacattcccattgatcacagggttctgagtaattcttggtggctcatcatgtatctcccg

SEQ ID NO: 1795 - DNA, 268 bp, Homo sapiens
accttactcccacgatcacttacaaccccacgatcacatacaccttcatctcaccgaaatggagtgggttctgcacatcatgtgcccggatcacactgaacccgatgtcactgcctgtggtcatcacgcccttgacagtaactgtggcaaccaggtggcttgacgaagaccagctgaagttcccactgccaccgtgggcccttattgtgtactgataggcgcccgtctttggttgccacggaaatgtcaagatgctgggatacagggt

SEQ ID NO: 1796 - DNA, 156 bp, Homo sapiens
caccttcatctcaccgaaatggagtgggttctgcacatcatgtgcccggatcacactgaacccgatgtcactgcctgtggtcatcacgcccttgacagtaactgtggcaaccaggtggcttgacgaagaccagctgaagttcccactgccaccgtg

SEQ ID NO: 1797 - DNA, 261 bp, Homo sapiens
tatagcatatgatcactccagagtgattttgcaacccgtagaggatgatccttcctcagattatattaatgccaactatattgatggctaccagagaccaagtcattacattgcaacccaaggtcccgttcatgaaacagtgtatgatttctggaggatgatttggcaagaacaatctgcttgcattgtgatggttacaaatttagttgaggttggccgggttaaatgctataaatattggcctgatgatactgaagttta

SEQ ID NO: 1798 - DNA, 272 bp, Homo sapiens
ctacattaaaacattcttaggccattgctttctaacttttatagcatctacagaaaatttcaataatgtacagtacactgagataaacagagaaagttggctccagctgccatctccatgtatgtatcatccacgctatcccctgctgcccggatgagactgaggagagaggatcagaagtcttgtgcaaccctggttggaatactctgcactgatattttttgaaaatcaactttattgaaatttagttttcagagagtaaacacacttat

SEQ ID NO: 1799 - DNA, 276 bp, Homo sapiens
  misc_feature (54)..(63): n is a, c, g, or t
ttctattaatatcctcttgcatgctttagaagccaaaggaaacagcccccacannnnnnnnnncctaaagcaatggtttcagttaagccaggcccatggcatctttggagacagaaagctaccctttccattcacggcaacatgacattcacaatgtgctttcctaaatggatggaaaacccctcaaaaaagcccctcaaatctgtgtttcataaactgtactcttagcaataaagtttattacagacctaaagtatctgcataaacccggttaat

SEQ ID NO: 1800 - DNA, 258 bp, Homo sapiens
gtgatgaagacccacaactctttgcatataatttcagagaagaactcaagcgaagaaaaagcaaaaatgaagaaaaagaagaggatgacgcagagaattacagactctagctgctgcctgggggcgagcagcctaccagatgtcgatttgcactacgtggagcttcttatataggtactcttttgtctttacagaatgacgatacaaatgccaatgaccagatgtgacttattttccttttactatacagcttggcag

SEQ ID NO: 1801 - DNA, 225 bp, Homo sapiens
tttgaaactcagtatgctgcccctgtcttgctgtcatgaaatcagcaagagaggatgacacatcaaataataaactcggattccagcccacattggattcatcagcatttggaccaatagcccacagctgagaatgtggaatacctaaggatagcaccgcttttgttctcgcaaaaacgtatctcctaatttgaggctcagatgaaatgcatcaggtcctttggg

SEQ ID NO: 1802 - DNA, 133 bp, Homo sapiens
gtttgaacctagaatattgaattaaaatgctgtctcagtattttaaaagcaaaaaaggaatggaggaaaattgcatcttagaccatttttatatgcagtgtacaatttgctgggctagaaatgagataaagat

SEQ ID NO: 1803 - DNA, 169 bp, Homo sapiens
ttcagagacggcaagcacctacaggacttgggctgcttcaggctgaacgctgggagaccacttcctgtgctgacacacagagctcccatctccatgaagaccgcacagcgcgtgtaagccagcccagctgacctaaagcgacatgagactactagaaagaaacgacacc

SEQ ID NO: 1804 - DNA, 277 bp, Homo sapiens
  misc_feature (199)..(199): n is a, c, g, or t
aaattgttcattttactggctctgatcagagaaaacaagcaaatgctgccttccttgttggatgctacatggttatatatttggggagaaccccagaagaagcatatagaatattaatctttggagagacatcctatattcctttcagagatgctgcctatggaagttgcaatttctacattacacttcttgactgttntcatgcagtaaagaaggcaatgcagtatggcttccttaatttcaactcatttaaccttgatgaatatgaacactatga

SEQ ID NO: 1805 - DNA, 247 bp, Homo sapiens
gagacttatagccacacaaccaatctctgcttcagactctgggtaaattactactgagtaagagctgggcatttagaaagatgtcatttgcaatagagcagtccattttgtattatgctgaattttcactggacctgtgatgtcatttcactgtgatgtgcacatgttgtctgtttggtgtctttttgtgcacagattatgatgaagattagaatgtgttatcactctgcctgtgtatagtcagata

SEQ ID NO: 1806 - DNA, 282 bp, Homo sapiens
cagtgtccgtctccggctgtcagaaatgcggtgagccgaaatttaaatgccctcccggagacggggacaagtcagcggctgcggagcgatctggctcacacaggcgatatgcggtccctactccaaggagctcaggatgcaaggggctttctgcccaccgcaaagcaacccccagccccccaaaacccagagagcaattaacacaataaagcaggaatgtccgaccggccgggagtcagcgtgaatatattcataaggcagaaatctcgaaagggtagtctt

SEQ ID NO: 1807 - DNA, 281 bp, Homo sapiens
aggctaagaagtcctttgggctaatgtttagggtcacgaagttcctttaaaaagagaggaaagcataccaaaagtccctatggattagttaaagtagttccattcagggcacccatctgcaaacccagaccttctgccaggacacagcttttgtttcctctccctctcaggcttgccatacagaagttctctccaatgaccttggagtgtaactgtctggacaggtccagttccttggagagcagtcctggtgccccttcctgtgagagtgggcttgtccc

SEQ ID NO: 1808 - DNA, 143 bp, Homo sapiens
gcaaaccgcagaaggcctccgcccccgccgcggaccctccgcggtacacctttgcacccagcgtctccctcaacaagacggcccggccctttggggcgcccccgcccgctgacagcgccccgcagcagaatggacagccgctc

SEQ ID NO: 1809 - DNA, 56 bp, Homo sapiens
gagaatgcgggtagcctcacacacatcgaagctcagaacaagatccgggcctgcgg

SEQ ID NO: 1810 - DNA, 285 bp, Homo sapiens
gcaagacgtcaacaggaacccgcaggcccggcctggacacctgctgccctcactggaagctttaactcccactcgagtctcttggcgtcgtcagtgccaggagcgcttggattgggatggggacggagaagggtgccatcgctcgccgagccccgctgcaccttggggacctggcaaagtcgaggtttcctcacagcgttgagattgagactgggggtcggtgagtggcgtcaattcccatgcccttgcggccatctcacaactggagtcgcagaagcgctcgct

SEQ ID NO: 1811 - DNA, 208 bp, Homo sapiens
gatgacaacaagcaacatttatctaatgaactacagctatcttaatttggttcttcaagttttctgttgcacttgtaaaatgctacaaggaatattaaaaaaatctattccctttaacttataatagtttatgaaataaaaacatgagtcccagcttttgttctgtggtaacctataaaaaaagtttgtctttgagattcaatgtaaa

SEQ ID NO: 1812 - DNA, 242 bp, Homo sapiens
gcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgaggaggctggggctaaggggctcccctgaatatcttctctgctcacttccaccatctaagaggaaaaggtgagttgctcatgctgattaggattgaa

SEQ ID NO: 1813 - DNA, 291 bp, Homo sapiens
gcctgacaggtcacaaggatccagtgttgctgataattccgggaggaatggggggcaaagagagccaggccgatgctgtcagtgtcctcagcggcgacgttctggaagaattaggacggctcgaggatccaaggtctgggacctccttcaaacagcatctcctttgaggagcccagggttaccaaggcaacagaggagggatccacagccttgaggggcaggtaggcagcaatggtgatcttggcactcaggtggacgtggccgtgtctgtagctcacaagacgcgtggta

SEQ ID NO: 1814 - DNA, 260 bp, Homo sapiens
gtatgtctcgtggtaggactgtagaaaagggaactgaacattccagagcgtgtagtgaatcacgtaaagctagaaatgatccccagctgtttatgcatagataatctctccattcccgtggaacgtttttcctgttcttaagacgtgattttgctgtagaagatggcacttataaccaaagcccaaagtggtatagaaatgctggtttttcagttttcaggagtgggttgatttcagcacctacagtgtacagtcttgta

SEQ ID NO: 1815 - DNA, 259 bp, Homo sapiens
tggctgcactcaagaccctcgagattaacggtgctaaccccgtctgctcctccctcccgcagagactggggcctggactggacatgagagccccttggtgccacagagggctgtgtcttactagaaacaacgcaaacctctccttcctcagaatagtgatgtgttcgacgttttatcaaaggccccctttctatgttcatgttagttttgctccttctgtgtttttttctgaaccatatccatgttgctgacttttcca

SEQ ID NO: 1816 - DNA, 251 bp, Homo sapiens
gaggagaactcttgaaatctccattttcaatcccttcgaaatcacgtatggtttccacaaagccgagtcgtgtcacgtggcaggtttacgtcaatagtccctctctctgctcctccattcgcaagtgtcttcctgggccagactcccctccacctcatgtacttgctatattgaggatgaagttttctatggtgggacactaaatataaagctatatagagaaagaatgtacggtcagttccctatggttt

SEQ ID NO: 1817 - DNA, 107 bp, Homo sapiens
tgcccgacaaacctccactggatggtttgtcactggatggtttgttggggtggtggtcacaggcgcaaaggacatgcacacggccacgctacgctactgtaaccaag

SEQ ID NO: 1818 - DNA, 287 bp, Homo sapiens
ttgaaactgtgccactgacctttacttcctccttctctactggagctttcgtaccttccacttctgctgttggtaaaatggtggatcttctatcaatttcaatgacagtacccacttctcccaatccttcgtcgataatggaggaagctgtaccagaaaacttttgcacagcactgggaagcactggaacaacagagctgctgactgtgaccagttgctcacctgagccctcagctgaggatgtaaactcttcccaggggaaggctgaagtgctgaccatggtgcta

SEQ ID NO: 1819 - DNA, 255 bp, Homo sapiens
tcccaaagttaggtggcccgtcgcaggcagcccctagtagtctggcctcctcgcccgcacaacccttcacccacaggccaggtgcaatcccgatgcaggctcctggcccgaccctctacgcgctcaggcggacagctaaggtctggctgagtctccggcaggggcgtttggaatgtgaccggtcacccactctcggccctgcatttgcttgtgcatgcaagtccacaggtgtagaggcacccgaaccgtgtgcat

SEQ ID NO: 1820 - DNA, 290 bp, Homo sapiens
aagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacaaaaa

SEQ ID NO: 1821 - DNA, 288 bp, Homo sapiens
aagatgaagccccatgctcagtcccctcccatcccccacgcagctccaccccagtcccaagccaccagctgtctgctcctggtgggaggtggcctcctcagcccctcctctctgacctttaacctcactctcaccttgcaccgtgcaccaacccttcacccctcctggaaagcaggcctgatggcttcccactggcctccaccacctgaccagagtgttctcttcagaggactggctcctttcccagtgtccttaaaataaagaaatgaaaatgcttgttggcacaaa

SEQ ID NO: 1822 - DNA, 250 bp, Homo sapiens
cacagatctgctccatccataaattcgaaaaccatgtaaagcattccatctgagctatatgtctccaataactctacaatgtgtggatgtttcagcatatgacagatactggcttcccgctttagatcttctgtacttaaccctggacttgatgtgaacttggctacatcaacaatttttacagcaaattgttgcccagtttctctgttgatacatcgtcgtacaacactgaagggaccctttccgatca

SEQ ID NO: 1823 - DNA, 271 bp, Homo sapiens
atggtcatcactggtctgtctgctctgttgtctgttctttccctgactccctcccaccgaaggcctgatggctactcacccctctgggatggctatgggagaggaggagtgatggggaccgccaccttttctgcaggaaatgtgcccagcagctcttggtcaaagcactgttgctataagctatctctgggatgcctctaggcccccttccctctacacacctctgggaaaagattacactgtattaactctcgaggagtttcctcaccaa

SEQ ID NO: 1824 - DNA, 225 bp, Homo sapiens
gccaatgtgggacagaagagcaacccaggaaatacaaagcaagcgctgtcaagagtgaagccgaagcccccctcacactctctagaggggaagcagcatcgtgctgtgatgaccaggaagggattaccgagggtccgttactagaacactgagatcaaacggaagatccagatgtgtctacagatgccagtctttgggctgctactgtccttacaaactcatgtc

SEQ ID NO: 1825 - DNA, 269 bp, Homo sapiens
cagaggcttctttttccgcggacggagacactgtacagcccaacctcgggaaaacgccaacgcagacggattctccaacaaaagatgggctcggactcaagagtgcggctccagggcaatgcagcccaacctaaagatttagaaggcttcccgttttcgtgggcgccagagccgcccacggcgactgcagtttcccaccgattaaaggtgggtttcacggtaactccctcagattgcggcggcgattcccgacgggttctcaacagcat

SEQ ID NO: 1826 - DNA, 255 bp, Homo sapiens
ctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctg

SEQ ID NO: 1827 - DNA, 254 bp, Homo sapiens
ggtgtggttgcactgaagttaacaagattcaaaccgtcgcccaagttggtatttccatgtttggtacacatcactctgtgccatatcaggtcgttgttaagtgtggtgacaaaatcagtggttagtcatttttttaattaaaaatgtgtatagtgtgtacctgctggtcttactgtatgtgcaactaaaggtttacatagtctgtgtatgggttgtaaatttttggctggctgtgctgataaagcattgggctt

SEQ ID NO: 1828 - DNA, 151 bp, Homo sapiens
ctagatgattccagtgcccttccatctatctctggaaactttcctcctccaccacctcttgatgaagaggctttcaaagtacaggggaatcccggaggcaagacacttgaggagaggcgctccagcctggacgctgagattgactccttga

SEQ ID NO: 1829 - DNA, 174 bp, Homo sapiens
ccgtcctcggccttgggcgaagaagtcgaggaggcggccgacgcggcctctccctccgcggccgtgggcgagccgggctcggcagcctcgccttccgcgggggcctccttctctaccgggctggccccggcctcgggggcagcggcggctgccggctcacctttcgcggccgcg

SEQ ID NO: 1830 - DNA, 300 bp, Homo sapiens
  misc_feature (40)..(50): n is a, c, g, or t
ccgctcagcttgaaagacttcttgaaggaaaagcgcttcnnnnnnnnnnncggggtctcgttgctgggcgagggcgtggccccgtcctcggccttgggcgaagaagtcgaggaggcggccgacgcggcctctccctccgcggccgtgggcgagccgggctcggcagcctcgccttccgcgggggcctccttctctaccgggctggccccggcctcgggggcagcggcggctgccggctcacctttcgcggccgcgaaaggcgacgccgccccgctcccggcggacgagggctcctccttg

SEQ ID NO: 1831 - DNA, 214 bp, Homo sapiens
ttagttaagaacatgacccgaagagtgaaaggtatttcctgttccaaataggagcccagtctgcattttctactacatgatttagtagaaagacacattgcatttgaaccatatttcttctgctagccaattccatcttatctacaactttttgataattattttgagaaatagatctagatcacagccttccaattcctaggccaggatactt

SEQ ID NO: 1832 - DNA, 236 bp, Homo sapiens
agggcttcactgcagagctgtcttcttggctggggctggtgggatgacaagacaagggatgtctgccagccctgtgggagtctctggaaggctaggccacttcccagttgggggctgtggacttctctcttctgtttctgcttggcgttgctgccttcgtcgccggtactcagataagctgagaggccgaggtctggcttcatgggttgtagcactggtaccactttcaattttca

SEQ ID NO: 1833 - DNA, 201 bp, Homo sapiens
tcactgaatcacagagcctttgcgtgaaacagctctgccaggccgggagctgggtttctcttccctttttatctgctggtgtggaccacaccagggcctggccgaaggaagagagagtttaccaagagagatgtctccgggcccttatttattatttaaacatttttttaaaaagcactgctagtttacttgtctctcctc

SEQ ID NO: 1834 - DNA, 287 bp, Homo sapiens
aggctacatatggatcttggtctcataaaaaataagcactaaaattaagttgagttgaggttgagtttagagttagtgctgctcatgccaccctaagcttccaagtatcattcagtcacatcttgtttcctgctttggggttatttaacaggtcattcgtgagttattacataactggaacaaaagcaagatagaatcaaaagaatacttagagctggagtgacatcagaaactgtatgcaacctccttattgtcaggacgggaaaaggcaagtctgggaagcaata

SEQ ID NO: 1835 - DNA, 234 bp, Homo sapiens
gcaaccacgagacggccttccaaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaa

SEQ ID NO: 1836 - DNA, 197 bp, Homo sapiens
aacaaatacacaggatttggtcattttctgccatgaatctagggcacgtgggtgccgggaaggagtcgggcagggggatgcaatagaggggaaagggccccatttccctcctctccgtcttcggagctgcgatcccaccctcagtccaagggcttaaacatctgcttttcggaactggaagcgcagcacaaaccttg

SEQ ID NO: 1837 - DNA, 215 bp, Homo sapiens
aacaaatacacaggatttggtcattttctgccatgaatctagggcacgtgggtgccgggaaggagtcgggcagggggatgcaatagaggggaaagggccccatttccctcctctccgtcttcggagctgcgatcccaccctcagtccaagggcttaaacatctgcttttcggaactggaagcgcagcacaaaccttgcttttcaaaggcgctggg

SEQ ID NO: 1838 - DNA, 298 bp, Homo sapiens
tgcagaagagtcaatctacctaagttttcatttttaaattgcagccggacagaaattcactttgctgcagggttgctttttgctaaatgctaatatgatcactgtgtgcccttatttgagtaatactgtaaaatgggagaaaagacggaaggagaactttaaagaagggaaggaccactcttcccctattgatggtatagggcagaaagtaaggacacaaagaacgagattcaaatgccattttacaggacaggagcccctgtcagtttacagcttgagacacgcgacgggtaccgag

SEQ ID NO: 1839 - DNA, 42 bp, Homo sapiens
accctgagtcttctcttcaggttcacagaacccgccgccttt

SEQ ID NO: 1840 - DNA, 276 bp, Homo sapiens
atccaatcacagatcatgaaacagtagtgttcccacctaggagtgttaggaagttgtgtttgtgtttcaagcagaaaaactgagctccaagtgagcacattcagctttggaaactatattatttaatgtaggctagcttgttttcaaattttaaaagtttaaaaataaaatactttgcattctaagttgccaataaaatagaccttcaagttattttaatgctcttttctcactaataggaacttgtaattccagcagtaatttaaaggctttcag

SEQ ID NO: 1841 - DNA, 207 bp, Homo sapiens
acttgctgccgtaatttaaagctctgttgattttgtttccgtttggatttttgggggaggggagcactgtgtttatgctggaatatgaagtctgagaccttccggtgctgggaacacacaagagttgttgaaagttgacaagcagactgcgcatgtctctgatgctttgtatcattcttgagcaatcgctcggtccgtggacaataa

SEQ ID NO: 1842 - DNA, 289 bp, Homo sapiens
tttttcctgtcttacctggatcttgcaataaaggatgcctggtttaattttcttgaaaatcacattagggaaggctttgaatgaaattgatctggaacaataagtgatgatttggaaaaacaattgctatacttctatgtaacctgctgcagctctccccatgtctccacctctagaggtggggttcagggatttgcataactaaaaaatttatgaaagtgttgtcctacctttctcaggaacaccatttgtgaattattttcccaaatatcgagggaggtgatcttct

SEQ ID NO: 1843 - DNA, 146 bp, Homo sapiens
gtttgggtcagtctccacctgggtatggtattatgttttataatcctgcatcacttctatcctatccagtcatatttaatgtagaaaattagtttccagtgaaagtaaaatgtagggcttttatgaaatttgtgggcaaaatcccc

SEQ ID NO: 1844 - DNA, 265 bp, Homo sapiens
gagaatgatgctttcgaagacggaggcaggcagtccttgatggagatgcagagtcgtcatggggcgagaacaagtgactctgaccagcaggcttaccttgttcaaagaggagctgaggacagggactggcggcaacagcggaatattccgattcattcctgccccaagtgtggagaggttctgcctgacatagacacgttacagattcacgtgatggattgcatcatttaagtgttgatgtatcacctccccaaaactgttggta

SEQ ID NO: 1845 - DNA, 299 bp, Homo sapiens
agccatctttatacttagggaagaaaaattgttgggttctagacttttttaatataaattttgttgatatggaattaggtaagtttaagtgtctatgtgcatatgtttttatataagttttttctattcagtttcactgatccaactggcagtgggtaaatatggcataagttaataacacttttccccaaaatggtgctttggatttgaaaagggtctgatggggagaaggagaacgtatcatcctagcttcctctcttataaacctagaaaaacgggtagtaaactgtggatagtca

SEQ ID NO: 1846 - skipped

SEQ ID NO: 1847 - DNA, 278 bp, Homo sapiens
aagagcaaatgcatcacccaggcctaaatgtccacaggccacttttgtacatgctcttttagaaacaccactctgaaaagatcttgttcgctaggtaagagaatgagtacacatataatcacaaatgcacactgatcatgactttatttaaaaattagcaaacaatactgtagaaacattgatatgtaaatttctaaaatgctgcatcttaaatttagttggcaaagaccacatttagcaataagcatgagtttagtcttccatgtagaaaccagata

SEQ ID NO: 1848 - DNA, 241 bp, Homo sapiens
tcttctgcagctttatggactggagcagagattgctgtgggggcaaactcttccagaaggtcagtagtagggttagagagcagagagcaatcaagcagggaatcttccccggtgagagaatctgtgcgattcgaggtcacagattccgtctgagatgggaggcgctggggaactgggggctccagtcctggtatgagactctcaacagcaacatcagctttttctttcgtaacagagcatt

SEQ ID NO: 1849 - DNA, 202 bp, Homo sapiens
gcaataaattaactttgtacacatttttatataaaaaaacagcaagtgatttcagaatgttgtaggcctcattagagcttggtctccaaaaatctgtttgaaaaaagcaacatgttcttcacagtgttcccctagaaaggaagagatttaattgccagttagatgtggcatgaaatgagggacaaagaaagcatctcgtagg

SEQ ID NO: 1850 - DNA, 261 bp, Homo sapiens
gtgattcctaggacttttcctcaagaggaaatctggatttccacctaccgcttacctgaaatgcaggatcacctacttactgtattctacattattatatgacatagtataatgagacaatatcaaaagtaaacatgtaatgacaatacatactaacattcttgtaggagtggttagagaagctgatgcctcatttctacattctgtcattagctattatcatctaacgtttcagtgtatccttacagaaataaagcagca

SEQ ID NO: 1851 - DNA, 234 bp, Homo sapiens
gtaattgtacaatacttgcattccagagttaaaatgtttactgtaaatttttgttcttttaaagactacctgggacctgatttattgaaatttttctctttaaaaacattttctctcgttaattttcctttgtcatttcctttgttgtctacattaaatcaaatgaatccattgaaagtgcttcaagggtaatcttgggtttctagccccttatctatgatgtttcttttgcaa

SEQ ID NO: 1852 - DNA, 276 bp, Homo sapiens
cggtactatacttctgtgcaggcaggttctggtgttggggacaagggtgtgagtgagaggactgagttgttgcctttaggaagtgtaccgtctagccaggagtaacggcttgagtcgaagtcggctcccattgggcctcttagggagtcccagtttgctctgaggcctgctcctctctgggaagaaatcaccttgagagcttctgggatttggaactccctgcatggttggatcccttccatcttcatgtgaatagtcttggtaatgaggctgccc

SEQ ID NO: 1853 - DNA, 254 bp, Homo sapiens
taagaaatgtcagccacggaaacaactctattatctggtgactttgggtaatgtgaatcagtgcctgaggacctttgctgtgtccttggtacagaaccatccacttgacctaactacctcccctggaccgctctcgctcttctcttctttgttaagccaacaactatcaccctctcctactcttcttctccctgccccctggagggcactgtgtttggttgtgcaaatgtatttactatgcgtgtttccagcag

SEQ ID NO: 1854 - DNA, 293 bp, Homo sapiens
gatttttctactggtctcattgctggccagtgtcggtgtaaattaaatgtggaaggagaacattgtgatgtttgcaaagaaggcttctatgatttaagcagtgaagatccatttggttgtaaatcttgtgcttgcaatcctctgggaacaattcctggaggaaatccttgtgattccgagacaggtcactgctactgcaagcgtctggtgacaggacagcattgtgaccatgtgcctgccagagcacctggggcttaagctatgagttggatggattcgccatgtactcgacc

SEQ ID NO: 1855 - DNA, 146 bp, Homo sapiens
ttcgtcatcaaacgtggtcaaacaggctgggtgccatcgctaaggaccccaaagtccgagacagggacgcgtgtgggcgtggtgcagtacagccacgagggcacctttgagggcatccagctggacggacgaacgtatcgactccc

SEQ ID NO: 1856 - DNA, 264 bp, Homo sapiens
gaccccggtctcacggagtgtgacgtcatgacctacgtgagggagacctgcgggtgctgcgactgtgagaagcgctgtggcgccctggacgtggtcttcgtcatcgacagctccgagagcattgggtacaccaacttcacactggagaagaacttcgtcatcaaacgtggtcaaacaggctgggtgccatcgctaaggaccccaaagtccgagacagggacgcgtgtgggcgtggtgcagtacagccacgagggcacctttgag

SEQ ID NO: 1857 - DNA, 155 bp, Homo sapiens
attttcatagaaattaggctggagaaagaaggaagaaatggttttcttaaatacctacaaaaaagttactgtggtatctatgagttatcatcttagctgtgttaaaaatgaatttttactatggcagatatggtatggatcgtaaaattttaagc

SEQ ID NO: 1858 - DNA, 236 bp, Homo sapiens
  misc_feature (140)..(141): n is a, c, g, or t
ttaagtgtttaagtgttattctgaattttctaccttagttatcattaatgtagttcctcattgaacatgtgataatctaatacctgtgaaaactgactaatcagctgccaataatatctaatatttttcatcatgcacgnnttaataatcatcatactctagaatcttgtctgtcactcactacatgaataagcaaatattgtcttcaaaagaatgcacaagaaccacaattaaga

SEQ ID NO: 1859 - DNA, 223 bp, Homo sapiens
  misc_feature (115)..(132): n is a, c, g, or t
tgagatgatcagacaccggagttcaacgtcccagcagtcttggtaaaaggagggagcctactgagccaggagggagaaaagaagattgaccagcttgctagaaaaatacttagcnnnnnnnnnnnnnnnnnngtggaggggggacggagaggaacaaggatggggaggtaggaatgaggtatagaaaagagatagcatcttctttggcacaagactagtggct

SEQ ID NO: 1860 - DNA, 278 bp, Homo sapiens
gctgtggagcccttaaagatgccatttggcttggcttccttgggaaagaagtcctgctggtagtcagggttgtccaggctaatttggtggctgcctttctgggcccagtggcgagggctgtcgaatgtgctgttgacacaggtgggctggacagtgttgagatactcggggttgcccactgcagtgctgtgggggtcctggtagtgtgggtctctgctgggcgcggggttcagaggctgattgtgatagacaggattctgcacagagccagcggcctt

SEQ ID NO: 1861 - DNA, 296 bp, Homo sapiens
cgagccagccatgggccacggagttgaggagccacagcacccagagcgaggctgggagcctgcctgccttcaccgtgccccaggcagctgccccgggcagcaccacccccagtgccaccagcagcagcagcagctgctccacgcccaatagccctgaagactattacacatctttggataacgacctgaagattgaagtgattgagaagctcttcgccatggacacagaggccaaggaccaatgcagtacccagacggatttcaatgagctggacttggagacactggcgagctag

SEQ ID NO: 1862 - DNA, 272 bp, Homo sapiens
ccgtacactcctctctggttttcttcctcaaaggaaatttatgcatgtaatccacaagccgaagaacccatgtttttctttggaaaaggctacgccctttcagggtttccttttctcggctgtgttgccttcccatcagaagctgtctcttgccctccccattatgggatgtgcgaaatgaaggaaaacagagacactgctgggcatttgtctccatgagttgatccaatcagaaatctttgacttttcacacatgtgtccaaaaatgagtg

SEQ ID NO: 1863 - DNA, 163 bp, Homo sapiens
ctgggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcc

SEQ ID NO: 1864 - DNA, 234 bp, Homo sapiens
gggcacatgtcccaagcctgtcagtggccctccctggtgcactgtccccgaaacccctgcttgggaagggaagctgtcgggtgggctaggactgacccttgtggtgtttttttgggtggtggctggaaacagcccctctcccacgtggcagaggctcagcctggctcccttccctggagcggcagggcgtgacggccacagggtctgcccgctgcacgttctgccaaggtggtg

SEQ ID NO: 1865 - DNA, 228 bp, Homo sapiens
  misc_feature (152)..(152): n is a, c, g, or t
  misc_feature (167)..(167): n is a, c, g, or t
taaatttcttaccacactcattcccaagttttatcccacaaagtatagcatgaaacaatgacaacatacatattattcaagtaaaatgctatttaaaatagctgcacacaggtaattaaaacacctaggatccagtttttagaggaaaaagncatgtggcacaattncaagttcataaattgagttaacagtaaaacagatttgctcacatttgcttctgatctttat

SEQ ID NO: 1866 - DNA, 142 bp, Homo sapiens
aaaggaaccagccaacgtatgagaaatgaatgtaacactgtggacattgacttcccgcataaggcagggtgaccccctgaactccagatgtctgcacagtatcttatgtgttgttttccgttgtgacgaatgtgattggaac

SEQ ID NO: 1867 - DNA, 213 bp, Homo sapiens
tcaggcaacctgacggagacctacgttcaggaccgtggcgatggcatgtacaaagtggagtacacgccttacgaggagggactgcactccgtggacgtgacctatgacggcagtcccgtgcccagcagccccttccaggtgcccgtgaccgagggctgcgacccctcccgggtgcgtgtccacgggccaggcatccaaagtggcaccaccaac

SEQ ID NO: 1868 - DNA, 168 bp, Homo sapiens
cactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtattt

SEQ ID NO: 1869 - DNA, 275 bp, Homo sapiens
gctatcaagggcctgatggaccccggggacccaagggagaagccggagacccagggccccctggactacctgcctactcccctcacccttccctagcaaaaggtgccagaggtgacccgggattcccaggggcccaaggggagccaggaagccagggtgagccaggagacccgggcctcccaggtccccctggcctctccatcggagatggagatcagaggagaggcctgccgggtgagatgggacccaagggcttcatcggagaccccggcatc

SEQ ID NO: 1870 - DNA, 219 bp, Homo sapiens
  misc_feature (89)..(102): n is a, c, g, or t
ggcttcacccttcgtaaccaggagacaaggcggccatggatttgcccttgattctattttgctaatggaagatagaaaggagagaaggnnnnnnnnnnnnnnaacattctgaagatggtgctgtgtcaagaaggaccttttttttcccctctcccctattttttaagtaccttggaggaggagaggttggtgacatgcatggtggggatctatggcctc

SEQ ID NO: 1871 - DNA, 260 bp, Homo sapiens
ctgggttgccaaaggtaaaatatataaaagagaagcctctgacttggttcctgcttctggtctctctccatcaaacgcattctgcccactacttatccttcccaaagatgaactttcatcacatgacatcagtggttcccaactgcttctccgataaagtccacaaagcctttctgtcctggcgctgcccactcatctaacttcaccttgcaccctgtgcccatgcccattctccataactcaaaccagtttcctgccat

SEQ ID NO: 1872 - DNA, 289 bp, Homo sapiens
  misc_feature (228)..(228): n is a, c, g, or t
  misc_feature (231)..(231): n is a, c, g, or t
gcatccacagtgaatgggatcccatccaggctgcggtggcacatcaccgcagggtgaaacaggtgaggatgattaggccttcccggtggctcggagaatccgctccatgatgggcttggaacacacattgcactgctccagagtattaatgtagcagggctcgcagtatgctttcttttccacagcataaaatggctgccctcggagcttgttgttgagatgatgcangtnaaacaatccacgtggaagacctgatccatggcagtgcattctgtacctttcccaacta

SEQ ID NO: 1873 - DNA, 162 bp, Homo sapiens
tggcaattggcactgaaggcacccaagcccctggagcctttcttgcggttagggctaacatggaccagctttggcagaggaactaagcaatccaataagatgttcttggaaagttttgagccactcccatcttctggcaaaatgtgggttgaaggcggatct

SEQ ID NO: 1874 - DNA, 247 bp, Homo sapiens
tggaaaaagacaacccagcagttctgtcccatctcagaaaaagtttccaatcaacaccaattatgtggtgacaaataactaggaatggtgacatctttgggccaagactgacaaggaagaatgggctctggtgctacggttcatctccaacaagaatatggcacaccggccagcacaagccatgctaacactgagcctttagcgctgggcacagattcagatctcttctctgaagctagcaaatcaa

SEQ ID NO: 1875 - DNA, 273 bp, Homo sapiens
  misc_feature (162)..(162): n is a, c, g, or t
tccttgaaacttccccaagtgtctgcacaacttaccttttcccgacttctcttcgacactcggctcccttcggcaaaccgggcaggccgaggacattagaaatttgggacgcacagaatgttcaagcctaggattttatgttgctgttttttttccagcggngcgtagggtggggcgcggtgctggggggactagggaaactttttccccaggaggacatggtctggcgggcgcgagcgcggcacaatttagtgcgtcgcacgcgtcgacact

SEQ ID NO: 1876 - DNA, 158 bp, Homo sapiens
gaggcgtttgacgttctaggttatccctccgcaaggggattctctgcctggcttgctgatgtcatatctggtggggagtggatttagatctgacactttttctgctcttcagaagcagaagcacaagcccagtatcccaattctggtttaatctcaaa

SEQ ID NO: 1877 - DNA, 261 bp, Homo sapiens
gagtctcattagtgtctgtgtttactgaacgctgcggacatcttttctatatacagtaattcttccaccctgtcacaacaaagagaagttgagtggcaggaatgggaaatctttacatgcttctttgggaaagaaaaatgcttatttgtacattgttctattgtgtgagacctacatagggttctgtgtaaggccgagtcaagctgtcatcactttccttggtaagtttgagagctttatctagcggacacgttctgaagt

SEQ ID NO: 1878 - DNA, 287 bp, Homo sapiens
taaaaacagtgggttgagccccagctccatgtattaggtagctaggtatattgtgggattattccttgttaagtcaccccaggaaacatttgcagaatttagaaatgcatccagatttgtgagtttatttttaagacctgactaaaaatctgcactcttcaaaaacttattgatgaagtacaaattgaggcagaaatttacattcctttgcttaatccctgagaatgagtataatgatcatagaactagttcgagagactgcaatgtgtccagactactgtcagacc

SEQ ID NO: 1879 - DNA, 154 bp, Homo sapiens
agttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgtta

SEQ ID NO: 1880 - DNA, 233 bp, Homo sapiens
  misc_feature (70)..(114): n is a, c, g, or t
tttttgctttagtatgaggaaagtaaggatgggcaaagaagcgatcaaaatagctattgctacaacattnnnnnnnnnnnnnnnnnnnnnnnnnnnnnnnnnnnnnnnnnnnnnctaaaaatgcttggcaaaaaaaatatagtgttaaaataggccagtgatattaatgagaaaatgaaagtatgtatcaggaataaagtgatattgcataggagtattgtatttttatgaat

SEQ ID NO: 1881 - DNA, 203 bp, Homo sapiens
  misc_feature (120)..(174): n is a, c, g, or t
tcaagttccaagttgctaatacagcaacaatttatgaattgaattatcttggttgaaaataaaaagatcactttctcagttttcataagtattatgtctcttctgagctatttcatctannnnnnnnnnnnnnnnnnnnnnnnnnnnnnnnnnnnnnnnnnnnnnnnnnnnnnntttgcatgtggatcaaccatcgctttatt

SEQ ID NO: 1882 - DNA, 256 bp, Homo sapiens
gtggtacccaggctttagcattattggatgtcaatagcattgtttttgtcatgtagctgttttaagaaatctggcccagggtgtttgcagctgtgagaagtcactcacactggccacaaggacgctggctactgtctattaaaattctgatgtttctgtgaaattctcagagtgtttaattgtactcaatggtatcattacaattttctgtaagagaaaatattacttatttatcctagtattcctaacctgtcag

SEQ ID NO: 1883 - DNA, 219 bp, Homo sapiens
ggcaagctcttcactatgacagtaaaggctctctgcctgctgccaaagcctgtgactttctaacctggcctcacgctgggtaagcttaaggtagaggtgcaggattagcaagcccacctggctaccaggccgacagctacatcctccaactgaacctgatcaacgaagagggattcatgtgtctgtctcagttggttccaaatgaaaccagggagcagg

SEQ ID NO: 1884 - DNA, 59 bp, Homo sapiens
tgccttgcatattacttgagcttaaactgacaacctggatgtaaataggagcctttcta

SEQ ID NO: 1885 - DNA, 194 bp, Homo sapiens
ttggaaaagtcctctcttcccagctcctgattctggatctgagattctcagatcacaggcccctgtgctccaggccgaggctgggccaccctcagggagatccagagactcatgcccatggccatccatgcgtggacgctgtgtggagagtccaggatgacgggatcccgcacaagctcccttcagtccttcag

SEQ ID NO: 1886 - DNA, 253 bp, Homo sapiens
gatatccaaatagctttattggcaagaatccacctctaggatgtccttcccgtattttgcttcatccttgaaactaacatcctaggagcaacacatgctgcctctttttaaaggggcctggaggcgtggggcagacccttgaaggaaggaaggagttggtgagctgagatggtgaatgagttgacattgtgggctatctttcagaatccgtttctgaatctatgtagctacttgattacagtttgggcttctc

SEQ ID NO: 1887 - DNA, 174 bp, Homo sapiens
atttcaacgacttcaagtccttcctgcttacacagccgaactaagaccacctcactggtggaagaccaaagaggccatttgcacctcaggctgctttctgacgccacagacctccagcaagcacaaatatttcaacctgcacattaatagtagatattattcgaggtcagcaga

SEQ ID NO: 1888 - DNA, 126 bp, Homo sapiens
gaaagtgttgccatgagggaagaacttaagggagtttagaaaagtaatgcgatgacgcaactgtaacactatgtttaaaaggatagtgtcctgggtgaaattactgttgcttcttttacgccagaa

SEQ ID NO: 1889 - DNA, 280 bp, Homo sapiens
gcatcatgcatgaaccttcgggcagggatatcattggtgaagtgatttcaaaaagtattcaaaatttgagatgctgtttagtcactacagtgccctcaaagggcagaagttgcagccttttttatattgcctgccaaaatatgaagtattagaagaaagtgttgccatgagggaagaacttaagggagtttagaaaagtaatgcgatgacgcaactgtaacactatgtttaaaaggatagtgtcctgggtgaaattactgttgcttcttttacgccagaa

SEQ ID NO: 1890 - DNA, 86 bp, Homo sapiens
aatgggaaccccttgtgagcatgctcagtatcattgtggagaaccaagagggcctcttaactgtaacaatgttcatggttgtgatg

SEQ ID NO: 1891 - DNA, 264 bp, Homo sapiens
aaagcaagggcttcaacagccttaaccaaatattattccccatagccagtggaaaatggatgtgacaaccccagtgcgcaggccagagtgagtgagcccagcacggcgctccgactggcttcctctctcaggtgctggattgtggggttagtggcatttccagctggattcctcctgttgtagttgccataaggaaatgagatgcagaatcagaaggatctatttctacagaatcatttcaccagttaagcacatgagtagaga

SEQ ID NO: 1892 - DNA, 89 bp, Homo sapiens
tggactcaagctattgttcacctcagcctcccttttgtgatttctaatttatttttagtaattaacaatgtattgcttgtataaatttt

SEQ ID NO: 1893 - DNA, 282 bp, Homo sapiens
  misc_feature (96)..(96): n is a, c, g, or t
tgcccttaacccgatttggccattcccctctctcccccgtactatacacccccgccccgccttccttcccgcctttgtgcgcctgtccgatcatantttccgcccatggtccacgttctccgccgcgtaacctatatcctggattctcttcccgccccgcgtgtgctacccccttattgccattttcccgttacgcggagttcgcccgaggcccggggctttgtcgccgcgtactttaggccccgccccgcctaagttccgccttcattataccgcgctgtg

SEQ ID NO: 1894 - DNA, 293 bp, Homo sapiens
atcaggtccctttgtggactcttgcaccttgctcccctgtttctctctctgcctgtaggtcttcataactccacataaaaatgcacttttgttctgaacatgtgataagtcactttccttgaactgctgtagtacagacagagctccttcttcattaaattccctgagagcatcaattgctctttcatcaagatcgacataagctaccaatccagggcagagcgggggccggcagccgggcccgtgagaatcagcgcgaggcgctttgaaaacgactagaaatggcgcgcgcg

SEQ ID NO: 1895 - DNA, 242 bp, Homo sapiens
gaaggagcaccctccacatggactcccacctgcaagtggacagcgacattcagtcctgcactgctcacctgggtttactgatgactcctggctgccccaccatcctctctgatctgtgagaaacagctaagctgctgtgacttccctttaggacaatgttgtgtaaatctttgaaggacacaccgaagacctttatactgtgatcttttacccctttcactcttggctttcttatgttgctt

SEQ ID NO: 1896 - DNA, 48 bp, Homo sapiens
ttttaatcacattttgtatggagttaaataaagtacagtgcttttgta

SEQ ID NO: 1897 - DNA, 263 bp, Homo sapiens
atgccagaaggaaagccgaaatgctacaaaatgaagcaaaaactcttttagctcaagcaaatagcaagctgcaactgctcaaagatttagaaagaaaatatgaagacaatcaaagatacttagaagataaagctcaagaattagcaagactggaaggagaagtccgttcactcctaaaggatataagccagaaagttgctgtgtatagcacatgcttgtaacagaggagaataaaaaatggctgaggtgaccaaggtaaaaca

SEQ ID NO: 1898 - DNA, 224 bp, Homo sapiens
aaggtctggaagctctgtgtagccattccttctgcagtcatcctacccaagtaaaagtaaccttggctatgttaccaccgttttggtcacccaggaggacatcttagcaagggtgcctgcgagggagtgtgggactgggcctcatcctcgccggcgttggaaaccaaggccttgtatgccacgccttatgaagcactgtttcacagttactttcacttcccgaa

SEQ ID NO: 1899 - DNA, 267 bp, Homo sapiens
cacgtgcttccttactaaggctgagagctcaactgaagaccttccccaataaatgacagatggctcttcagtcaggaatgcagttagtggtttcatgacagacacactggtcccacctggcttccctgctgaaccacccagtactgaataacacctgtaccaatgtgggatgacatcagctaggaagcaaagtaatttgcctggttgatgattattttttatacctaatgattcacccaatagtaaaggaaccccacagctaagatc

SEQ ID NO: 1900 - DNA, 268 bp, Homo sapiens
tgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaa

SEQ ID NO: 1901 - DNA, 297 bp, Homo sapiens
  misc_feature (149)..(149): n is a, c, g, or t
acatctgccgctaaccgtgaaacaccaccacccgtggttcgccccagttcgccacctcccgcccttttgcctccacgcgctgtacccacgccgtgtggcggaacaaacctcgccgacattgacacaaagtgcctccctcttgttgatcnctcccacgcgccggacaaactagcctcgcccccagtgaacatccaggccccgcagggcggatcatggaccatataccttctctgcatcaccggcctccctatagacacacactcccgctctgctgagtgatatacacgcccgccaggg

SEQ ID NO: 1902 - DNA, 263 bp, Homo sapiens
ctcatgggtcttgcccgatgggctggtcacctgggctgtcatatcctggatgctaatttcagggattttcaggctgaggtcacaatgactaccaacgttggccactgaaggagcccgacgcctgcgggtgatgctctctttcacccggccctcgcctgtcaccttcacagagaaggggctgccaggcacgtgctggtcggcaaacttgatgttgatgatgtagttgcctggctctgtggggcagtaggtgaccctgcacgtcc

SEQ ID NO: 1903 - DNA, 199 bp, Homo sapiens
ggaccggggcagaattaacgtgcaaagaaatgggttggtgaagttttctttacaggccctttccggggcggcccgctggaagaccccttccgccaacacgggctcttcaacggaagcccgggaaatcgcccgcgggcgcattaccacacgcccgccgccgcgcgcatccgcatatataaatactctggcccccagaggg

SEQ ID NO: 1904 - DNA, 236 bp, Homo sapiens
aaagagcacgtgcttctttgtctcacgggtcaggctgaactcgtactggatgggtgaactgctggtattctcatggcggcagtccagacgaaggctctggtccactaggcaggccgttaggctggtcaccttctgccctcgggagacctgcaagactgttagcaggagagcgatgctgatggccaggctcatggttctgggatctcagtcctggatctggactgggtcttccgctg

SEQ ID NO: 1905 - DNA, 208 bp, Homo sapiens
ataaaggaccgtttacctcttgctgtggtaggtagtaatactatcattgaagttaatggcaaaagggtcagaggaaggcagtatccttggggtgttgctgaagttgaaaatggtgaacattgtgattttacaatcctaagaaatatgttgataagaacacacatgcaggacttgaaagatgttactaataatgtccactatgagaact

SEQ ID NO: 1906 - DNA, 102 bp, Homo sapiens
tttgtcattgttgccatcatatggaagataatgtttacatccttttaaacatttttatatgacaattcctcaggatttggtaaggcttccaagttgtagctt

SEQ ID NO: 1907 - DNA, 144 bp, Homo sapiens
atgtcatgttagctgggagtcttcccacatgtggcacttcaaaaggcagcaccactgggcgcctgcacttatttgaaaatggaactttgggagaagtatccctgctagtggctctgtaacttaacagatgacaattaggctttt

SEQ ID NO: 1908 - DNA, 241 bp, Homo sapiens
  misc_feature (91)..(101): n is a, c, g, or t
gggtctcctctctcgggcggctactactccacaccgagagggagtgtcttacaaggcggccggcgtgcaaacaaaaaaataatataaccgnnnnnnnnnnntcggtcgcacctatattcgagcaaagaaaagcgtgggtggtaaagtatattctataaacacaatttcctcgcgcccaccacggtggaatacccactccccataaaacggccggtgggagaagactctcgaacaccgcccg

SEQ ID NO: 1909 - DNA, 229 bp, Homo sapiens
gccgaccggcgcacatgtgataagaagatactgtggggtggcccccccttgcggccccccagaaagaaatctttttaaaaccccctttttcttttttgggcggccgcgggggcgcccccccgataggggacaaggccgggatacggggggctcgaaaccgttgtggccccttccacagaggaaagatacccggtggccacccggataaataaccgcggcctgtgtgttt

SEQ ID NO: 1910 - DNA, 168 bp, Homo sapiens
agtgaagttctcagatgctggccagcctatgagttttgtcttagaatttcactttgaacccaatgaatattttacaaatgaagtgctgacaaagacatacaggatgaggtcagaaccagatgattctgatcccttttcttttgatggaccagaaattatgggttgtac

SEQ ID NO: 1911 - DNA, 176 bp, Homo sapiens
ttctatctgggcacacgtgtttcacgttgacaggtttgcttgggacgctagtaaccatgggcttgctgacttagccaaagaagagttaagaagaaaatacacacaagtatacagactgttcctagtttcttagacttatctgcatattggataaaataaatgcaattgtgctcttc

SEQ ID NO: 1912 - DNA, 262 bp, Homo sapiens
gctgggaagtggagctcagcttccagaatctcctggtccctctcaaagggaatgtccccacacaccatgtcatagaggaggatgcccagtgaccagacagtggccgggagtgcatggtactggtgtcgagagatccactctggggggctgtacacccttgtcccatcaaagtcagtgtagggttcatcatgaagcagggcaccagaaccaaaatcaatgagtttggcacagccacggcgtaggtctatcaggatgttctcat

SEQ ID NO: 1913 - DNA, 291 bp, Homo sapiens
agaagagcgctatcctgaaggcatcaagtggaaattcctagaacataaaggtccagtatttgccccaccatatgagcctcttccagagaatgtcaagttttattatgatggtaaagtcatgaagctgagccccaaagcagaggaagtagctacgttctttgcaaaaatgctcgaccatgaatatactaccaaggaaatatttaggaaaaatttctttacaagactggagaaaggaaatgactaatgaagagaagaatattatcaccacctaagcaatgtgatttaaccaga

SEQ ID NO: 1914 - DNA, 290 bp, Homo sapiens
agacggatgggtgactagacccatggagaggaactcttctgcactctgagctggccagcccctcggggctgcagagcagtgagcctacatctgccactcagccgaggggaccctgctcacagccttctacatggtgctactgctcttggagtggacatgaccagacaccgcaccccctggatctggctgagggctcaggacacaggcccagccacccccaggggcctccacaggccgctgcataacagcgatacagtacttaagtgtctgtgtagacaaccaaagaataa

SEQ ID NO: 1915 - DNA, 180 bp, Homo sapiens
ttgcaccagcgtggcggtgtttactggcgccttgatctatgccattcacgccgaggagatcctggagaagcacccgcgagggggcagcttcggatactgcttcgccctggcctgggtggccttccccctcgccctggtcagcggcatcatctacatccacctacggaagcgggagtgagc

SEQ ID NO: 1916 - DNA, 237 bp, Homo sapiens
ccctggttgctgtatttgttcagtgactattctcggggccctgtgtagggggttattgcctctgaaatgcctcttctttatgtacaaagattatttgcacgaactggactgtgtgcaacgctttttgggagaatgatgtccccgttgtatgtatgagtggcttctgggagatgggtgtcactttttaaaccactgtatagaaggtttttgtagcctgaatgtcttactgtgatcaat

SEQ ID NO: 1917 - DNA, 244 bp, Homo sapiens
  misc_feature (164)..(179): n is a, c, g, or t
  misc_feature (193)..(193): n is a, c, g, or t
tctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgcnnnnnnnnnnnnnnnncttcccttttcccntttctcggttctcttttctctcctctggaatgggctgaagacccctctgcc

SEQ ID NO: 1918 - DNA, 212 bp, Homo sapiens
agaagtttgggctgatcgccagtgatagtaaacaaaatctgtgcagagggccttagcatgggatgtgtccagtattgaaaaggctgcactgccaaccatgatttgtgagccttctgggaaattttgttattaaaggaatatatagtgtcagacggaagttataatcatcttggaggaaccataagaaaaggtgtccagggtatctatataaa

SEQ ID NO: 1919 - DNA, 220 bp, Homo sapiens
ctgcaagtgaatttcactgatgttgatattcattgtgtgtagttttatttcggtcccagccccgtttccttttattttggagctaatgccagctgcgtgtctagttttgagtgcagtaaaatagaatcagcaaatcactcttatttttcatccttttccggtattttttgggttgtttctgtgggagcagtgtacaccaactcttcctgtatattgcctt

SEQ ID NO: 1920 - DNA, 236 bp, Homo sapiens
ttctcacaggagtataaggtacaggatagggattattaatattcccatttgccagatgcagaaacagactaaaagaggtgaagtgacctgcctaagggccagacctgggccttgaaccaaaggttttcccactcctagtccagggctctttccatgatataaggggctattcagtttggtaaagccagtggaacactttctttcaagtgttgcatgcacttcccaatagataaact

SEQ ID NO: 1921 - DNA, 261 bp, Homo sapiens
agcttcatttttgttacctgatagaatagcttttcttatgagatatatataatgtgatactatgtttggatatttttggtcttaaagcaagactcagtggtgtatcttcattaaaagcttcctttaaaaaagttacagagttactaaaaaaacaagtacccaaacaatcaagttgggccaaccttggaaccttgttttgaatatctttcattgttttgtttgtcgtattgtaaaaagaatgtatggttgaaaactcaggaa

SEQ ID NO: 1922 - DNA, 158 bp, Homo sapiens
tcccaagggtcgctagaaactcgtcttcgcgttgccccctttctggctctcagcgccgtcgccactcgggagaggctgggtgaggcccgtgtgaggactgaccctggattcctcgaaactgccattgtgatcattactctgctctttggaaatggctg

SEQ ID NO: 1923 - DNA, 65 bp, Homo sapiens
aatgcaatgcactaaaactattttaagaatgtagttaattctgcttattcataaagtgggcatct

SEQ ID NO: 1924 - DNA, 246 bp, Homo sapiens
gagccttcacgtaaatgggtccagtcatgcctcccagtaagaagccagaaagctcaggaattagtgtctccagtggactgagtcagtgttacgggggcagcggtttctccaaggcccttcaggaagacgagtgacctcgacgttttctctgcctgacatccgattataagaagggggccatggaagatgaagagctgaccaacctgaactggctgcacgagagcaagaacttgctgaagagctttg

SEQ ID NO: 1925 - DNA, 271 bp, Homo sapiens
gccgatgactgcgacccagtgactggggagtgcttgaactgccaggactacaccatgggtcataactgtgaaaggtgcttggctggttactatggcgaccccatcattgggtacaggagatcactgccgcccttgcccttgcccagatggtcccgacagtcggacgccagtttgccccggagctgcaaccaagatacctgttactttactgctgcctgtgtttgtgatcctggatacattggttccagatgtgacgatctgtgcctacagg

SEQ ID NO: 1926 - DNA, 178 bp, Homo sapiens
gccccagccttaggtttggagctctggatgacatacataagtaggagcagtgggaactgtttctgtcataatggaaggctgaaagcgtggagtgaactcaggtcctacagttcatgggtggcttttggttggtcctggcctttacgggaaggaagcaaagctataccgccctaaggga

SEQ ID NO: 1927 - DNA, 279 bp, Homo sapiens
ggttcatgtgagatgcagaggcaatgagcttgagccttcctacctttacttccggctggatacttgctctggggaacaatcccatcaataccgcagacggctttgccggccgccttcgccaaagcctgggattcggaaacatacggggaaacggggcgcggaatccgaggagggccacgacagcgaccagggagaaaaacggcaggtgcgggaagaacctgggccacacaacaaaaacacggaagtgagaacacctggccacacgaaggaagacatgaa

SEQ ID NO: 1928 - DNA, 150 bp, Homo sapiens
aaagggtcgttgtggtgcatagacccagagtatagacaaaatctaattcaggctttgaaaaagacaccttatcacccacacccacacgtgttcaatacacctcccacctgtcctcaggcatatcaaagcacatcaggtccacccatctgg

SEQ ID NO: 1929 - DNA, 61 bp, Homo sapiens
ctgctgtgaccatcatgtggtctttgttctccttctgtcgtcttctcggatcctctagatc

SEQ ID NO: 1930 - DNA, 228 bp, Homo sapiens
aaaccagctgagtgcctgctttttactccttttatgtctggccttctaggatctggtccaagacactctcagggcctgggaggcagggcatagaaatcagttcttcactctccctaatactacactctgtaaggacctggggcaggatatcttctccccccaggggatcttctatttaagtggcttttgagagggtgaacaggattgttacttttaagcctacctctg

SEQ ID NO: 1931 - DNA, 249 bp, Homo sapiens
gatttttgtgggacaactctagcccacaaactgactggctggtgagtcttgactcccttccaacacagatgcccaggcacctccagatcattcacttcgcacgtgggccttgtgaagggatttgtgaatatccaggaagaacttagaggaccccatctgagttcggatggtcaggaaacaatctgggcaaaaaagaggcaggcatttcaaaggaaggggcaaggaagactggcaaacagatggcaaggc

SEQ ID NO: 1932 - DNA, 213 bp, Homo sapiens
gaccttttcatcaatagatcgcccttaaagacccattgtaaggtcataaaaaacctcggccaactgcacaaagatggtgcctcactgcaacaagaaaccttaaggtgtcttaccgacgaaataaaaaacataaatgattgttctccaaggcctgagggcaagactcatgatgggcaagtcaaccccaatctggaacaatgtccctcctcttag

SEQ ID NO: 1933 - DNA, 169 bp, Homo sapiens
ctgaagccccactctggacccaggacattttgatgagatccaaaggagttgtatgcacatgaaagtttgagaagcatcatcatagagaagtaaacatcacacccaacttccttatctttccagtggctaaaccacttaacctctctgggtgttacctgctcatttgttt

SEQ ID NO: 1934 - DNA, 280 bp, Homo sapiens
tccagatgactgagaccacgtgttcagacagcagcgttggttcactggccaacgtgcaggtctctggagggggacctagcttctccttgtgtgatgaacgactcccagggtcgccaagaatgaggcgctctggcacccgaccgctgaacttgccacttgaggccccagggagactgtgcgaacttgcagtgaagttccaggtgatgacacatgaccaatcactgagactcctgctggggtcctcagtctccttggacctgtgggttctccatggacacgg

SEQ ID NO: 1935 - DNA, 180 bp, Homo sapiens
gggtgatgccctacgtttactgaattttccacttggatcctagatattggatcccaaaagatggcaaattaaagggcacaccctgaaagaaacctgggaagctaacttgggtattccaaaggaatttttccccaaggcatttgcccttctatacccaagacttcaggttcccctggcaaa

SEQ ID NO: 1936 - DNA, 71 bp, Homo sapiens
taagagaattcccgccaaagggccaaaattggcctgggtaaacttttgcaggaacggtcactcggctctca

SEQ ID NO: 1937 - DNA, 206 bp, Homo sapiens
gtcactcggctctcagtgtcctggacgtggacggtatgaaggtgaaaggcagagcagtgaagattagaccgaagaccaaggactggctgaaaggtttgcgagaggagatcattcggaaacgagacagcatggcccccgtgtctcccactgccaactcctgtttgctggaggaaaactttgacttcacaagtttggactatgagtca

SEQ ID NO: 1938 - DNA, 233 bp, Homo sapiens
  misc_feature (34)..(91): n is a, c, g, or t
aatgctggaagtggccccagcatccttccgccannnnnnnnnnnnnnnnnnnnnnnnnnnnnnnnnnnnnnnnnnnnnnnnnnnnnnnnnngcaggacagctcattttatattatcaaatcccgttcttttaacacgcgacagtcgcgcagtttaatcttccctccccccctatgcctcgcccattgcccgttggcggttatacgcagtatcctgataacgtagtacccgcgc

SEQ ID NO: 1939 - DNA, 122 bp, Homo sapiens
ggatacttttatatgatgggtgctttgagtgtgaatgcagcaggctctcttgtttccgaggtgctgcttttgcaggtgacctggttacttagctaggattggtgatttgtactgctttatgg

SEQ ID NO: 1940 - DNA, 262 bp, Homo sapiens
aagtatttcttgagcccaattgtggacgttcagttaggggtggcagttaacgctgacctctgcagttgcgttggtggaaatcacccagctgggatccatgcgcgtcattcccagactcagtggggtgtgcctccattgcaaagacagttgcacagaagctcaacacagacccattgttgctccagtttttcaagtctcaggggtaaccctcaagccgctgtggtgcagagggttatgcgtgtttcacaattaagccgcgaca

SEQ ID NO: 1941 - DNA, 103 bp, Homo sapiens
tgaacgtgcccgtgcttgggaagctgcacgctcctgcaaggaggggacctctttcagagctcctggaccaggacacttgagccaggccttctacctggcatca

SEQ ID NO: 1942 - DNA, 261 bp, Homo sapiens
gaacagcaagagcaggttcccgccactgtgctacgccacccagtaccaggactacagcctgtcgtctgcccacaaggtgtcaggcatggcaagccggctgctcgggccctcatttgagtcctacctgctgcccgaactgaccagatatgactgtgaggtgaacgtgcccgtgcttgggaagctgcacgctcctgcaaggaggggacctctttcagagctcctggaccaggacacttgagccaggccttctacctggcatca

SEQ ID NO: 1943 - DNA, 65 bp, Homo sapiens
gatgtctggcccgctgggtcaagaagccaacaagtcatgttggctcggcagaatgcatccctggc

SEQ ID NO: 1944 - DNA, 238 bp, Homo sapiens
agggtcctgtttgtgcttcctgtagacacccttttcctgcgcaacagagctgggcctccctttctctaatttcccccttaacatgcctggggggcatacaatccaacccgtgccctctcctctcttcctgccaaggtttatagaaacctgagaatctgagggtgatgtctggcccgctgggtcaagaagccaacaagtcatgttggctcggcagaatgcatccctggcattcccaggt

SEQ ID NO: 1945 - DNA, 281 bp, Homo sapiens
  misc_feature (173)..(173): n is a, c, g, or t
acagatgtgaccaaagtaaggactttgaatgctatcgcaaagaacatcctggtgtagccagacctctctgagagacatggatatcacagggatgaaggtagaactataatctgcaattctctatgacacagctttaaccttcttctctggccaggacagtcgcaatcctttgnttttaattttcacatgggccatgggagaatgtggcccaaagaaagaaaaagaaatttggaaacaggagatacaggtcactttcctttttgcttagtccttaaccagtg

SEQ ID NO: 1946 - DNA, 120 bp, Homo sapiens
tgctatcgcaaagaacatcctggtgtagccagacctctctgagagacatggatatcacagggatgaaggtagaactataatctgcaattctctatgacacagctttaaccttcttctctg

SEQ ID NO: 1947 - DNA, 294 bp, Homo sapiens
ttctaggtatagaactatgttattgaaaggaaaaggaaaactggtgtttgtttcttagactcatgaaataaaaaattatgaaggcaatgaaaaataaattgaaaattaaagtcagatgagaataggaataatactttgccacttctgcattatttagaaacatacgttattgtacatttgtaaaccatttactgtctgggcaatagtgactccgtttaataaaagcttccgtagtgcattggtatggattaaatgcataaaatattcttagactcgatgctgtataaaatatta

SEQ ID NO: 1948 - DNA, 140 bp, Homo sapiens
ttatacttttgtagactctcctgtgttgtccatattgtatacttttggtgattccagctatttaacctctatgtctctgctaaggtgattatttgtatatagcactcggccctgtgatattatagagtttcccgtggaga

SEQ ID NO: 1949 - DNA, 55 bp, Homo sapiens
cccagagctgagtggtgcccgcaaaccgccggctgcccaatcaagtaccacaacg

SEQ ID NO: 1950 - DNA, 165 bp, Homo sapiens
tcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccg

SEQ ID NO: 1951 - DNA, 259 bp, Homo sapiens
tcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtggtgcccgcaaaccgccggctgcccaatcaagtaccacaacg

SEQ ID NO: 1952 - DNA, 243 bp, Homo sapiens
tacccttctgcgagctgaaaatgaaacaggaaacatggcgatccacatggtctaccagaaccagatagctgagctcatgctgagtgagtacagtaagatcttcggctcagaggaagactgacagacaagacaagctactgaatacgttcacatctgtcttgatgcctaatatttttacatttctgtaaacatatttctgaaatattttttgcctttcaagcgacagatgcctcattttgtgaa

SEQ ID NO: 1953 - DNA, 269 bp, Homo sapiens
gtgaacgatcatttctgacttaaccgtgagatgctcacgagtacccttcctgttgttttgttagcattgaaatcgagactatttatttggaatatatacaacagtgtttttccactgtatttcatttgcaaaagttgagaactgctttctctaccctttgccaaattaatgaatatccaatatgggattttcaaagactccgatatggtgaacctattaaacctagaaattgtattcatcctttcatgactgtggcctgagttccccag

SEQ ID NO: 1954 - DNA, 272 bp, Homo sapiens
tcctggcaaggcattcgctcctgagcggaatcctgcaaagatggagaaggaggagacaacccgggagctgctgctgcccaactggcagggtagtggctcccacgggctgaccatcgcccagagggacgactgtgtgtttgtgcaggaggtgacgcagaactcccctgcggcccgcactggggtggtcaaggagggggaccagattgtgggtgccaccatctactttgacaagctgcagtcgggtgaggtgacccagctgctgaacaccatgg

SEQ ID NO: 1955 - DNA, 65 bp, Homo sapiens
aaaagccaagtgtgccccaaagattgttccatggaagtgacattctacacaggtgacagatttgg

SEQ ID NO: 1956 - DNA, 245 bp, Homo sapiens
gctcaatgtcaagtcatctttggcacaaaagccaagtgtgccccaaagattgttccatggaagtgacattctacacaggtgacagatttggcaattgtggttactctggccatgaatacaagaagtgtgccactgggaatagctttgtgtggaaagcttcagtgtgagaatgtacaagagatacctgtatttggcattgtgcctgctattattcaacacgcctagtcgaggcacccaatgttggg

SEQ ID NO: 1957 - DNA, 181 bp, Homo sapiens
  misc_feature (109)..(109): n is a, c, g, or t
  misc_feature (151)..(151): n is a, c, g, or t
gaaagcaatggtgagcaatctggtttactggtaacttcaatatgaactgtgaatgtgccacatgactttttcctctaaaactggaatcctagggttttaatttactggngtgcagctattttaaatagcatttacttggagaaaaaaaggnaggttgggcattgtttcatggctaaacttt

SEQ ID NO: 1958 - DNA, 287 bp, Homo sapiens
  misc_feature (106)..(106): n is a, c, g, or t
  misc_feature (215)..(215): n is a, c, g, or t
  misc_feature (257)..(257): n is a, c, g, or t
gagctgatctgcatctgtttatccattttagtagcttttaaatatgattttatgtgaagtgccatttttcttatctactaaagagagacagcagaaataaagatcngaaagcaatggtgagcaatctggtttactggtaacttcaatatgaactgtgaatgtgccacatgactttttcctctaaaactggaatcctagggttttaatttactggngtgcagctattttaaatagcatttacttggagaaaaaaaggnaggttgggcattgtttcatggctaaacttt

SEQ ID NO: 1959 - DNA, 191 bp, Homo sapiens
agatctgcatccttagagaccaagaaggatgtaaatgacactggcagttttaagcctccagaagtagcatctaaaccttcaggtgctcccatcattggtcccaaacccacttctcagaatcaattcagtgaacatgacaaaactctgtacaggatcccagaacctcaaaaacctcaactgaagccacctga

SEQ ID NO: 1960 - DNA, 276 bp, Homo sapiens
agaagacaggtgtggccgtcaacaagccagcagagttcacagtggatgccaagcacggtggcaaggccccacttcgggtccaagtccaggacaatgaaggctgccctgtggaggcgttggtcaaggacaacggcaatggcacttacagctgctcctacgtgcccaggaagccggtgaagcacacagccatggtgtcctggggaggcgtcagcatccccaacagccccttcagggtgaatgtgggagctggcagacaccccaacaaggtcaaagtat

SEQ ID NO: 1961 - DNA, 221 bp, Homo sapiens
gtcacacaagaatgagaagcgctttaagtgtgaccagtgtgattacgcttgtagacaggagaggcacatgatcatgcacaagcgcacccacaccggggagaagccttacgcctgcagccactgcgataagaccttccgccagaagcagcttctcgacatgcacttcaagcgctatcacgaccccaacttcgtccctgcggcttttgtctgttctaagtgtg

SEQ ID NO: 1962 - DNA, 275 bp, Homo sapiens
  misc_feature (213)..(213): n is a, c, g, or t
  misc_feature (224)..(237): n is a, c, g, or t
acagagacctgctacacttatgacagaaacaagtgctacacagctgtggtcccactcgtatatggtggtgagaccaaaatggtggaaacagccttaaccccagatgcctgctatcctgactaatttaagtcattgctgactgcatagctctttttcttgagaggctctccattttgattcagaaagttagcatatttgttaccaatgaatttngaaccagggcnnnnnnnnnnnnnngggggatgtaaaacaactccctgccaccaaaataatta

SEQ ID NO: 1963 - DNA, 137 bp, Homo sapiens
catgtctataaagaaagatggcactgttgaagaaaagcggggaggaagattggagaaacagactcagcaggaggcaggagggcggcagcgccgccacagccgcacacccagaagcaggcgtccctcatcagaagcgt

SEQ ID NO: 1964 - DNA, 121 bp, Homo sapiens
tggaagccccaggattcttcggaacagccgcaggagaagctctgcaagaatccatgtgcgatgtttgctgctggagagatcaaacgccgacaggggagggccttcttgactcacccagcaa

SEQ ID NO: 1965 - DNA, 263 bp, Homo sapiens
acgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgccgaagacccagcttgag

SEQ ID NO: 1966 - DNA, 243 bp, Homo sapiens
aatcaaagcagtagccacatggtgctggctcctttgcagcacaaacctggtcattttgatgactgtacaacaggaagacttgaaaaatcacgtggattcatattaccaccgctctcatttcatggagtcttctgatcaaaaaagctcacgtcgtatttcttcttttcctttctcttttctagaaattgggtgtttgtaccagaatggaattttgcttctcggttatcctgtgcttcagatgat

SEQ ID NO: 1967 - DNA, 244 bp, Homo sapiens
  misc_feature (103)..(103): n is a, c, g, or t
  misc_feature (219)..(219): n is a, c, g, or t
atattcgcgccccatggtagccaaacaccgagcacaaccactccccctcttgtcgcggctcgtaccacatacccgtctcttacgcgcgccacaagcatgaggngctcacgcccatcttttttgtccacctccgtgatgaaaccccgcgcccactgactttattagcgccctacgcactacacataattgccgccagcctgatacccacaccgcgtcctnatagatcactcgtcgccctgtagcg

SEQ ID NO: 1968 - DNA, 32 bp, Homo sapiens
ttgagatactttaaagaattccagagcatatc

SEQ ID NO: 1969 - DNA, 156 bp, Homo sapiens
atatgtgtagtagttgaattgtgttatcaaagcatgtccaacttctgtccagatgacattaaaaccaaagcctaattgttaagcctcttattctaaagtccatagcaatgctatggaatatcaagtataatgatgtagtaaaaagatttctccaga

SEQ ID NO: 1970 - DNA, 291 bp, Homo sapiens
tccacggagaagaactgctgcgtgcggcagctgtacattgacttccgcaaggacctcggctggaagtggatccacgagcccaagggctaccatgccaacttctgcctcgggccctgcccctacatttggagcctggacacgcagtacagcaaggtcctggccctgtacaaccagcataacccgggcgcctcggcggcgccgtgctgcgtgccgcaggcgctggagccgctgcccatcgtgtactacgtgggccgcaagcccaaggtggagcagctgtccaacatgatcgtg

SEQ ID NO: 1971 - DNA, 273 bp, Homo sapiens
acacttcgagcactgtccagtattctaccgtggtacacagtggctacagacaccaagttccgtcagtccaagtcttctcaagatccgagtctacccagcccttgttagattcagaggagtggccagaagatctacaattagtagatcatgtagatggcggtgatggtatttttcccaggcaacagtacttcaaacagtactgcagtcagcatgaatccagtccagatatttcacattttgaaaggtcaaagcaagtttcatcagtcaatgagg

SEQ ID NO: 1972 - DNA, 212 bp, Homo sapiens
gaaaagcggttcatcggctgtttgggaaatggcatgaaagcatctactgtggcggcggctcctcttctgcctgtgtatggagagcaaatcctatgccgaaaggctacgagcaatactatagcttcacacagtttgcgctggaattaaatgaaatggatccatcatcaaagtctttattgccacctactgacactcgatttaggccagaccag

SEQ ID NO: 1973 - DNA, 221 bp, Homo sapiens
atttgtatgagtttggagcagtgctgaaggccaaagccgcctactggtttgtagttaacctagagaaggttgaaaaattaatcctacctttaaagggatttgaggtaggctggattccatcgccacaggactttagttagaattaaattcctgcttgtaatttatatccatgtttaggcttttcataagatgaaacatgccacagtgaacacactcgtgta

SEQ ID NO: 1974 - DNA, 160 bp, Homo sapiens
atatttggacataacagacttggaagcagatgatacagacttctttttttcataatcaggttagtgtaagaaattgccatttgaaacaatccattttgtaactgaaccttatgaaatatatgtatttcatggtacgtattctctagcacagtctgagcaa

SEQ ID NO: 1975 - DNA, 268 bp, Homo sapiens
aaaggcattggctacttcttcgttttgcagcccaaggttgtagatggtactccatgtagcccagattccacctctgtctgtgtgcaaggacagtgtgtaaaagctggttgtgatcgcatcatagactccaaaaagaagtttgataaatgtggtgtttgcgggggaaatggatctacttgtaaaaaaatgatcaggatcagttactagtgcgaaacctggatatcatgatatcatcacaattccaactggagccaccaacatcgaagtg

SEQ ID NO: 1976 - DNA, 281 bp, Homo sapiens
attgttgctgtaaaggtatcccctgtttcctacctgagggtttccatgagccctgtactgcacacccagaacaaggaggccctggtggccgtgcctttgggaatgaccgtgaccttcactgtccacttccacgacaactctggagatgtcttccatgctcacagttcggtcctcaactttgccactaacagagacgactttgtgcagatcgggaagggccccaccaacaacacctgtgttgtccgcacagtcagcgtgggcctgacactgctccgtgtgtg

SEQ ID NO: 1977 - DNA, 241 bp, Homo sapiens
cttggggccagtaaatcagtagactgaacattcaatataataaaagaacatggggattttgtataaccagggataataaaaagaaaacagaagttgatttttaattgatgtttttgaaacttagtagaacaaatattcagaagtaacttgataagaaatgaatgtttctaaagaagtttctaaagattcggaaaatgctccttgtcacattagtgtgcatcctacaaaaagtgatctctta

SEQ ID NO: 1978 - DNA, 245 bp, Homo sapiens
aaagccactgaaggaggcacatggagaaattctctattccgcctttttcctagagtggttctctgaggaagcccgccgtgtttacggagacattatctacaccccggcaaaggacaggcgggccctggtcctcaagcagcccataggcgtgggctgcagtcatcaccccgtggaatttccccagtgccatgatcacccggaaggtgggggccgccctggcagccggctgtactgtcgtggtgaag

SEQ ID NO: 1979 - DNA, 291 bp, Homo sapiens
cagtacatgtttctgcggcagcggctgcaggctctggacactggatggaacgagctccacaagatgtgggagaacagacaaaatctcctatcccagtcacatgcctaccagcagttcctcagagacacgaagcaagccgaagcctttcttaacaaccaggtaaggtttgttcctgcctttgcttcctttcggtgaaagcagcgctggctgccttttgaaatgttttggctggggcagctggtttaaaccacaccctgtatggaatatatggataatttagagaccgcgatg

SEQ ID NO: 1980 - DNA, 242 bp, Homo sapiens
ggattcacgggtagagattggcttcgggctgagctagcagtgagcaccttttggcccaatgaatatcaggtaatatttgaagctgaagtctcaggagggagaagtggttatattgccattgatgacatccaagtactgagttatccttgtgataaatctcctcatttcctcccgtctaggggatgtagaggtgaatgcagggcaaaacgctacatttcagtgcattgccacagggagagatg

SEQ ID NO: 1981 - DNA, 202 bp, Homo sapiens
cgttacaccaacccgaggctctttgtttcccctcttggatctgttgagtttctttgttgaagaagccagcatgggtgcccagttctccaagaccgcagcgaagggagaagccgccgcggagaggcctggggaggcggctgtggcctcgtcgccttccaaagcgaacggacaggagaatggccacgtgaaggtaaacggcgac

SEQ ID NO: 1982 - DNA, 260 bp, Homo sapiens
tttttgtaatatatggtgacttcagatttttttgtacagtattttgaatgtgagatgattgtcaggactaactgtctttttaacaaaacattttcagtattttaaataaaattttgtaaagtaatgtgaattaaaaattttggaacaattagaattcattcactattgtatagaagatgctgttaaaacataggaagggtatttttcttgatccaaagtttgtgaatttggctttgctacctcaattgcaggtgtttgtt

SEQ ID NO: 1983 - DNA, 224 bp, Homo sapiens
gcaaagtacataatatgtggtcactttgtaaccactaacaataaaggtagggtggtaaaaagaaaagggagaggagcaagcatcttaaaaggggggaaaaaaagcctaagtctgtatttagctactcaccctgctcctgaggcaggactgggtaggcactccctgcctctaagaccacagccaagctgacctggaatgccagtccccggtatgaggaaggcagc

SEQ ID NO: 1984 - DNA, 265 bp, Homo sapiens
gcctttttgtctgtctttatttacagcaaagtacataatatgtggtcactttgtaaccactaacaataaaggtagggtggtaaaaagaaaagggagaggagcaagcatcttaaaaggggggaaaaaaagcctaagtctgtatttagctactcaccctgctcctgaggcaggactgggtaggcactccctgcctctaagaccacagccaagctgacctggaatgccagtccccggtatgaggaaggcagcagaacgcccagagaca

SEQ ID NO: 1985 - DNA, 293 bp, Homo sapiens
accacctggcaatacagtccactttctggtttcttttattgtgggaagtaaatggtcaagctgctcaggcagtgaaaagatgtggagaatgtccgttgtcattcttgccactgtattccatttgctaccgagatataacattaaggtggacacattttctaactgtattaattaaaagtcaatggatacagagagtggattttctccccaagtcccatccctgctgaagaccgcttggatgactccccaacccactgtgcccctcccgcaacactaccagtaacaacaacgcg

SEQ ID NO: 1986 - DNA, 32 bp, Homo sapiens
tgagtaacattcatgcaatgagcactcagtgg

SEQ ID NO: 1987 - DNA, 283 bp, Homo sapiens
aggactgtctcgaggccacactcgctcggcaggattattcgatcacggatcagtcagagcagggtcaggagacggggctgacggcacgggtggcggggacagacgtttgggacttggccgcgactctctgcttctctccagctctcaatctgctgcattttcctctagtgcttccggatcctcttcattcttttcggcatactcaaccactccgcatgctgctggaatatttctggctttagaagtacaggaggcgcagatggctaactgagtaacattcatg

SEQ ID NO: 1988 - DNA, 137 bp, Homo sapiens
tcctgagctcgggagatgttcagagtcacactgccgcccggtctgccacgcagaggtccaacttgccacccgcgtccctggtacctgagaccaccgacatcctcaggttcctgaccgtggcgcccttctacccagcc

SEQ ID NO: 1989 - DNA, 239 bp, Homo sapiens
gtcagagagacggacacaaggagccggcaggagggcggagcgaggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcct

SEQ ID NO: 1990 - DNA, 215 bp, Homo sapiens
aggatgtcctttcccgggagacaagtcgggaaagcctggctggactgcctcagccccgcgcgcctcctggactcagggttccccgtcctgagctcgggagatgttcagagtcacactgccgcccggtctgccacgcagaggtccaacttgccacccgcgtccctggtacctgagaccaccgacatcctcaggttcctgaccgtggcgcccttcta

SEQ ID NO: 1991 - DNA, 32 bp, Homo sapiens
tattaagtgtataccctataatcgacattctc

SEQ ID NO: 1992 - DNA, 106 bp, Homo sapiens
tccaccctgtgactggggaaatcattacctcctttacacactagacaactatgatagcactaacatgccattgatgcaaacgcagcagaacttgccacatcagact

SEQ ID NO: 1993 - DNA, 285 bp, Homo sapiens
gggaaatcattacctcctttacacactagacaactatgatagcactaacatgccattgatgcaaacgcagcagaacttgccacatcagactcagattccccaacagcagacttacaggtaaatggtatccctgaagaaagaaaactgactgaagcaatgaatttataatcagactcatatagcagttacatcacatttcttttctcttcctataatgcatgagcttttctgtcatatgttatgcatgttgcagtattaagtgtataccctataatcgacattctc

SEQ ID NO: 1994 - DNA, 132 bp, Homo sapiens
tttattcaaatccaatagcaagctctgttttctaatatagtaaatgtctttatagtaatagtgagtaatcatcaattctaaagatagaattattattacaataaacaaactttagtcacatattggcagttt

SEQ ID NO: 1995 - DNA, 89 bp, Homo sapiens
tggctttagtgtcaaatgggatccccctaaggacaatggtggttcagaaatcctcaagtacttgctagagattactgatggaaattctg

SEQ ID NO: 1996 - DNA, 270 bp, Homo sapiens
ccatccgggcaaaggacttggagtttggaggagtacctggtgtgtttctcatcatgtttggcctgcctgtgttcctcttcctgttgctgttgatgtgtaaacagaaagatcccagtcttctgaatttccctcctcctttgccagctttgtatgagttatgggaaaccagagtatttggggtctacctcctgtggtttctgattcaagtcctgttctacctactgccaatttggaaaggttgtagagacgcctcttactgatgggagcaga

SEQ ID NO: 1997 - DNA, 242 bp, Homo sapiens
accgtctgcgacgacaagtgggacctggtgtcggccagtgtggtctgcagagagctgggctttgggagtgccaaagaggcagtcactggctcccgactggggcaagggatcggacccatccacctcaacgagatccagtgcacaggcaatgagaagtccattatagactgcaagttcaatgccgagtctcagggctgcaaccacgaggaggatgctggtgtgagatgcaacacccctgccat

SEQ ID NO: 1998 - DNA, 33 bp, Homo sapiens
tgctgctcaggaccactgatggacgaagacttc

SEQ ID NO: 1999 - DNA, 262 bp, Homo sapiens
gagacttccttcatataggagctggaggacacagcacattggaaatcaagaagaaaataaaagtaaaaacaggaattctaatgtcatcccatatgactataacagagtgccacttaaacatgagctggaaatgagtaaagagagtgagcatgattcagatgaatcctctgatgatgacagtgattcagaggaaccaagcaaatacatcaatgcatcttttataatgagctactggaaacctgaagtgatgattgctgctcag

SEQ ID NO: 2000 - DNA, 272 bp, Homo sapiens
gcctatgtctcctcctgggtacaagctggttactggcgacagaaacaattcttcttgccgcaattacaacaagcaagcaagtgagcaaaactgggctaattacagtgcagaacaaaatcgaatggggcaggcgggaagcaccatctctaactcccatgcacagccttttgatttccccgatgataaccagaattctaaaaaaactagctgctggacatgaattacagccactagccacttgtggaccagcgcctttcacagttcgtagggat

SEQ ID NO: 2001 - DNA, 60 bp, Homo sapiens
atccgggatatgttactgtccggcagcagttttaactggccgtatatggcaattcaataa

SEQ ID NO: 2002 - DNA, 264 bp, Homo sapiens
ctgcagttgagtccgccacaaaaaagcacgaggccattgagacagacattgccgcatacgaggagcgtgtgcaggctgtggtagccgtggccagttagctcgaggccgataattaccacgacatcaagcgcatcacagcgaggaaggacaatgtcatccggctctgggaatacctactggacctgctcagggcccggagacagcggctcgagatgaacctggggctgcagaagatattccaggaaatgctctccttatgtgcta

SEQ ID NO: 2003 - DNA, 296 bp, Homo sapiens
gtcagccttgccagtgtcacaacaacattgacacgacagacccagaagcctgtgacaaggagactgggaggtgtctcaagtgcctgtaccacacggaaggggaacactgtcagttctgcccggtttggatactatggtgatgccctccggcaggactgtcgaaagtgtgtctgtaattacctgggcaccgtgcaagagcactgtaacggctctgactgccagtgcgacaaagcccactggtcagtgcttgtgtcttcctaatgtgatcgggcagaaactgtgaccgctgtgtattc

SEQ ID NO: 2004 - DNA, 260 bp, Homo sapiens
  misc_feature (216)..(216): n is a, c, g, or t
aagatgaaacttcgagctcctctgaagcaaattctcggtgtcaaacaccaataaagatgaagccaaatattgaacctcctgagaatgtggagtggagtggtgctgaagcctcaatgtttagagtcctcattggcacttactatgacaatttctgtgccattgctaggttaattgggaccaaaacatgtagacaggtgtatgagtttagagtcaaangaatctagcatcatagctccagctcccgctgaggatgtggatac

SEQ ID NO: 2005 - DNA, 46 bp, Homo sapiens
atgccagccttctcaacctttgcagaaattactagagaggatttga

SEQ ID NO: 2006 - DNA, 286 bp, Homo sapiens
  misc_feature (110)..(110): n is a, c, g, or t
  misc_feature (174)..(174): n is a, c, g, or t
  misc_feature (180)..(215): n is a, c, g, or t
  misc_feature (240)..(240): n is a, c, g, or t
  misc_feature (255)..(255): n is a, c, g, or t
cagccttctcaacctttgcagaaattactagagaggatttgaatgtgggacacaaaggtcccattttgcacgttagaaaatttgtgtccacaaggacaagaacaaagtantgagctttaaagctccataggaaacttgttaaatcaacaagagaagtgttaatgctgcaagtantcctcnnnnnnnnnnnnnnnnnnnnnnnnnnnnnnnnnnnncaagccaaaataggaatattaagangaggggactgggtangtgagaatatcagctccggtttgggatggtg

SEQ ID NO: 2007 - DNA, 261 bp, Homo sapiens
tgtacctctagaatcccagcagcagagaaccatcaaggcgggagggcctgcagtgattcagcaggcccttcccattctgccccagagtgggtcttggaccagggcaagtgcatctttgcctcaactccaggatttaggccttaacacactggccattcttatgttccagatggccccagctggtgtcctgcccgcctttcatctggattctacaaaaaccaggatgcccaccgttaggattcaggcagcagtgtctgtacc

SEQ ID NO: 2008 - DNA, 288 bp, Homo sapiens
  misc_feature (33)..(33): n is a, c, g, or t
  misc_feature (147)..(147): n is a, c, g, or t
aaatatcttgcgttagcgtgaaagtatgttganttaacacggggagcccgccccgaactaccatgcaagaacccccgccgaaaaacgagacttttgtgtatcgccgtgatgtcggggcggtggggaacactcgccggcgggtggcanagcgcgggggtggcacaaagattgattaccccgcaataagaccggcccgatcgtgcaacacggcgcgtcttcattctcgcgccacaacccctatattattgttctcatcagcgacggttctttgtacgacaatgcacacgg

SEQ ID NO: 2009 - DNA, 294 bp, Homo sapiens
ttatgggacgaagaattggaacacatggaaaccctgtgcagactcccgcgacatcttccctcctctccaagtcccttcccacagaccttgcgccccacacgattattccccaggggccgagcaggacgacttgggtcccactatccggactcagcggtgcccccacaaaagcgtcccaaaaactccagctggggcagccctggggccgatgctgaaaagttgtcagaggccctcgggcagtcccgagatctaccccaggccagagggcctgaccctccctaaatgcgacgttct

SEQ ID NO: 2010 - DNA, 201 bp, Homo sapiens
actgctgcatggtgttgccctttctcatcttgactgtccgccggtgcccagagccatcccagtagctgaaggtgatctcgatctcctcactcttgatcttctcctgcttggcttcccactcctgccgcagctcttcccgaagccgattctcctcctcctcacggtctcgatcaggcaagaagcttgtgtcaacgtctgggt

SEQ ID NO: 2011 - DNA, 55 bp, Homo sapiens
atctttccccttgcggtactaatctattggcgcacaaggagggcgtcacagtgct

SEQ ID NO: 2012 - DNA, 145 bp, Homo sapiens
gtagtgagctgcctttctgtgatcggtttccctagggatgttgctgttcccctccttgctattcgcagctacatacaacgtggccaaccccagtaggctgatcctatatatgatcagtgctggtgctgactctcaatagccccac

SEQ ID NO: 2013 - DNA, 254 bp, Homo sapiens
gtagtgacctgtttatgagatgctggttttctacccaacggccctgcaaccagctcacgtccaggttcaacccacagctacttggtttgtgttcttcttcatattctaaaaccattccatttccaagcactttcagtccaataggtgtaggaaatagcgctgtttttgttgtgtgtgcagggagggcagttttctaatggaatggtttgggaatatccatgtacttgtttgcaagcaggactttgaggcaagtg

SEQ ID NO: 2014 - DNA, 261 bp, Homo sapiens
gaatatctttatcaacttcaggagtttttggtgacagataatagtagaaattggcggtttcgagctgaactggctgaacagctgattttacttctagagttatatagtcccagagatgtttatgactatttacgtcccattgctctgaatctgtgtgccgacaaagtttcttctgttcgttggatttcctacaagttggtcagcgagatggtgaagaagctgcacgcggcaacaccaccaacgttcggagtggacctcatc

SEQ ID NO: 2015 - DNA, 225 bp, Homo sapiens
acaacgtgtcgtgcgcgcaccgaagccttacgaccccgacgggcggtggggacacctatcaggaaacaaaaaacggcggcaccgctgctaggccccgcaaggagagaaacaacacgaacagcgagtgatgccccactaaatggctcgcttttaatgacggaacaagccgtctgcgccccagaaccgcgagtgctcaccggaatagaatccgcaccagcgctaggt

SEQ ID NO: 2016 - DNA, 215 bp, Homo sapiens
tccaatgaatcagtccgtaccaagataccccaatgctgtaggattcccatcaaacagtggtcaaggactaatgcaccagcagcccatccaccccagtggctcacttaaccaaatgaacacacaaactatgcatccttcacagcctcagggaacttatgcctctccacctcccatgtcacccatgaaagcaatgagtaatccagcaggcactcctc

SEQ ID NO: 2017 - DNA, 253 bp, Homo sapiens
aactactgactcgtgtattagtgagtattatctcttctccatccttaggaaaatgttcatcccagctgcggaggattaacaaatgggtgattgagctttctcctcgtatttggaccttgaaggttatataaatttttttcttatgaagagttggcatttctttttattgccaatggcaggcactcattcatatatgatctcctcaccttcccctcccctaaaaccaatctccagaactttttggactataaat

SEQ ID NO: 2018 - DNA, 294 bp, Homo sapiens
  misc_feature (187)..(187): n is a, c, g, or t
  misc_feature (262)..(262): n is a, c, g, or t
  misc_feature (269)..(269): n is a, c, g, or t
agtgcagacccataatctgtgacaagtattgtccacttggattgctgaagaataagcacggctgtgacatctgtcgctgtaagaaatgtccagagctctcatgcagtaagatctgccccttgggtttccagcaggacagtcacggctgtcttatctgcaagtgcagagaggcctctgcttcagctgngccacccatcctgtcggacacttgtctcaccgtggatggtcatcatcataaaaatgaggagagctggcacgatgngtgccgngaatgctactgtctcaatggacggg

SEQ ID NO: 2019 - DNA, 271 bp, Homo sapiens
cgaactcaacccgaagaaagccagggcctatggcagaggaatcgagcccactggaaacatggtgaagcagccagccaagttcactgtggacaccatcagcgccgggcaaggagacgtgatggtgtttgttgaggacccagaagggaacaaagaggaggcacgagtgacccctgacagtgacaagaacaagacatactctgtggagtatctgcccaaggtcaccgggctactacaaagtcacagtcctcttgcaggacagcacatctccgaa

SEQ ID NO: 2020 - DNA, 34 bp, Homo sapiens
ttttcttgtcggcttcctatcagaatattcagag

SEQ ID NO: 2021 - DNA, 203 bp, Homo sapiens
ttgaatggtaaacttgagcatcttttcactttccagtagtcagcaaagagcagtttgaattttcttgtcggcttcctatcagaatattcagagactcgagcacagcacccagacttcatgcgcccgtggaatgctcaccacatgttggtcgaagcggccgaccactgactttgtgacttaggcggctgtgttgcctatgtaga

SEQ ID NO: 2022 - DNA, 35 bp, Homo sapiens
gggatttccaatattatgggcatggagtaaatggc

SEQ ID NO: 2023 - DNA, 243 bp, Homo sapiens
gactgagtgagtcggtccttagccctccgtgttttgtgcgaaatctgccatggaagattatggtgatgccacgcttttatccagacagaccacaccaaaaaagcgtagggattctttctccagtgcaatgctgaatctgattccacgtcatggtcttgcgaatgcacaagcagtgctgaagataataacttacagagatgatgaaaagtcgttcagtcgtcgtattagtcatttgttcttcca

SEQ ID NO: 2024 - DNA, 36 bp, Homo sapiens
gtggggttgtaagtgatcgtgggagtaaggtccgag

SEQ ID NO: 2025 - DNA, 211 bp, Homo sapiens
agcatcttgacatttccgtggcaaccaaagacgggcgcctatcagtacacaataagggcccacggtggcagtgggaacttcagctggtcttcgtcaagccacctggttgccacagttactgtcaagggcgtgatgaccacaggcagtgacatcgggttcagtgtgatccgggcacatgatgtgcagaacccactccatttcggtgagatga

SEQ ID NO: 2026 - DNA, 93 bp, Homo sapiens
  misc_feature (33)..(48): n is a, c, g, or t
cattaagtcctctgtaaggtgtcaggcaagccnnnnnnnnnnnnnnnntgggtaagtcctaaccccccacaaaggtgttcccagtgactacct

SEQ ID NO: 2027 - DNA, 243 bp, Homo sapiens
accaaagccatatgggtggaagtcagttggcctccctggttctgcagagggccagaagaatgagagagaggaagactgctggcagggaaatcgaggaggcgagactagaactgcaccagcttccctgatgtctgcagccatggctttgcagcgcagacagagcttctctgggatgctgggattcttgcctgtatgaatgcatcaagtattcatttattgcccgaataggcattgcattaagtc

SEQ ID NO: 2028 - DNA, 224 bp, Homo sapiens
tctgttgccttggtaaccctgggctcctcaaaggagatgctgtttgaaggaggtcccagaccttggatcctcgagccgtcctaattcttccagaacgtcgccgctgaggacactgacagcatcggcctggctctctttgccccccattcctcccggaattatcagcaacactggatccttgtgacctgtcaggccttgggtgagcaggtcatcgccctgtcggt

SEQ ID NO: 2029 - DNA, 245 bp, Homo sapiens
ttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttgggtagctattcattaggggagtctggacttgtagctgggagacgtgttggaacacc

SEQ ID NO: 2030 - DNA, 290 bp, Homo sapiens
tcggcttcactcttgacagcgcttgctttgtatttcctgggttgctcttctgtcccacattggctcattgccatctgtcccttgtccatgcttccttacaaagtggacctttttcctccgcctcttccctgttcagatgctcctcgacttaaaatggggttacatcccaataaacccatcgtaagttgaaaaatagcgtgtcaaaactgcatctcatacacctaacctagcaaacgtcatggtctcgctgaccttgaacacactcagaacacatacattagcctacggct

SEQ ID NO: 2031 - DNA, 278 bp, Homo sapiens
tttcccgaggttgggctgtacagtgtctccgtccgcggaaaaagaagcctctgaacccgggccggcccgcagcccccgtcgtttccggccgctgctcgccgtcgcccagaggctaggccacgttttcccccagtgccgaggtgtttctgtgacccctccctccactcccattcccttctgaaagggcacctgctcttggtgagaaaagaaattatagcacgaagagccagtatcagaagagtatccatcacccgcagcaaccgctcagggaacaccat

SEQ ID NO: 2032 - DNA, 234 bp, Homo sapiens
  misc_feature (127)..(137): n is a, c, g, or t
gaaggcgaggctgccgagcccggctcgcccacggccgcggagggagaggccgcgtcggccgcctcctcgacttcttcgcccaaggccgaggacggggccacgccctcgcccagcaacgagaccccgnnnnnnnnnnngaagcgcttttccttcaagaagtctttcaagctgagcggcttctccttcaagaagaacaagaaggaggctggagaaggcggtgaggctgaggcgccc

SEQ ID NO: 2033 - DNA, 273 bp, Homo sapiens
gaagagagaagtccacagcccccaactgggaagtggcctagccttccagagactcccacagggctggcagacatcccttgtcttgtcatcccaccagccccagccaagaagacagctctgcagtgaagccctgaaacaccccttgagatttgccttgtgcctataggtcccagccctgcttctcctagtcctgagccacctgtaagcaaacctgtgcctcatctcccactgagcaggtgccatcccagaagatgccactgttggcgagacctt

SEQ ID NO: 2034 - DNA, 213 bp, Homo sapiens
gattaaattgctattgctgtagtaagagaagctctttgtatctgaacatagttgtatttgaaatttgtggttttttaatttatttaaaattggggggagggcatgggaaggatttaacaccgatatattgttaccgctgaaaatgaactttatgaaccttttccaagttgatctatccagtgacgtggcctggtgggcgtttcttcttgtact

SEQ ID NO: 2035 - DNA, 255 bp, Homo sapiens
agtattactcaaataagggcacacagtgatcatattagcatttagcaaaaagcaaccctgcagcaaagtgaatttctgtccggctgcaatttaaaaatgaaaacttaggtagattgactcttctgcatgtttctcatagagcagaaaagtgctaatcatttagccacttagtgatgtaagcaagaagcataggagataaaacccccactgagatgcctctcatgcctcagctgggacccagcttgagacccgcga

SEQ ID NO: 2036 - DNA, 167 bp, Homo sapiens
aggtgggcactctagaaacagcagtgggagctctgagtccagtcttcccaacctagccaggtctttactgctggtggatcagctcatagacctgtagccgtgacccagtagcagatgcagttctgtaaccttcataccgtaaaatacattttcattacggagttatg

SEQ ID NO: 2037 - DNA, 269 bp, Homo sapiens
ggaagccaagccaaatggcatctttaagggctccacagctgaaaatgcagaatacctaagggtcgcgccacaaagcagtgaatttattggagcatgaccacggaggatagtatgagccctaaaaatccagactctttcgatacccaggaccaagccacagcaggtcctccatcccaacagccatgcccgcattagctcttagacccacagactggttttgcaacgtttacaccgactagccaggaagtacttccacctcgggcacattt

SEQ ID NO: 2038 - DNA, 159 bp, Homo sapiens
gtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcat

SEQ ID NO: 2039 - DNA, 278 bp, Homo sapiens
tcctctaaaaactggatcctaggtgttttaattacctgtgtgcagctattttaaatagcattttacttgaataatatgtatgttgtcattgtttcatgctatactttgtgggataaaacttgggaatgagtgtggtaagaaatttataaagttttgcttttaaaacgtggacataactcatttttctagtttttgacaattgtgtgttttagtgtctagtctgcagagagctgtgtgattaataaacgtggaattaacagaatttcctctccctgtaa

SEQ ID NO: 2040 - DNA, 212 bp, Homo sapiens
aggagactgtccgtattgtggctttggatcgagatttccatgttcactgctaccgatgcgaggattgcggtggtctcctgtctgaaggagataaccaaggctgctaccccttggatgggcacatcctctgcaagacctgcaactctgcccgcatcagggtgttgaccgccaaggcgagcactgacctttagattcagtcacctgttcagccg

SEQ ID NO: 2041 - DNA, 225 bp, Homo sapiens
gaatctgtgcccagcgctaaaggctcagtgttagcatggcttgtgctggccggtgtgccatattcttgttggagatgaaccgtagcaccagagcccattcttccttgtcagtcttggcccaaagatgtcaccattcctagttatttgtcaccacataattggtgttgattggaaactttttctgagatgggacagaactgctgggttgtctttttccatgtaact

SEQ ID NO: 2042 - DNA, 293 bp, Homo sapiens
ggaagtttcaaggagaccgccagctcaagatggaaaccgcggcccgggcgctaagaacgggcttcagctcccgctggcaaaaagagaaagtcgagcccgccttcctgcccaacaaaaaacaacaacatgacaacaagaaccccggagggagtggaatgagtgacgtcacagccgcgctctgaggctgacaaaggagggggcgcgcccctcccgctctgcgcccgcgcggccccggagagggggcgcctgaagcgccgggtagggaagtcagccgacttgaaacttttcctctt

SEQ ID NO: 2043 - DNA, 239 bp, Homo sapiens
aacccaagggcgctgctgcagcttctgagagccttcccgctggcccgcgacgtctatgtgggaaggcccagcctgaaccggcccatccatgcctcagagccacagccccacaaccgcacgaggctggtacagttctggtttgccactgggggtgctggcttctgcatcaatcgcaaactggctttgaagatggctccgtgggccagtggctcccgtttcatggacacatctgctctcat

SEQ ID NO: 2044 - DNA, 280 bp, Homo sapiens
gcatttctgtggcaaacaacagactttttgttggatccattccgaagaataagactaaaagaaaacattttggaagaattcagtaaagtcacagagggtttggtggacgttattctctatcatcaacccgatgacaaaaagaagaatcgggggttctgcttccttgaatatgaggatcaccagtcagcaagcacaagccagacgccggctgatgagtggaaaagtaaaagtgtggggaaatgtagttacagttgaatgggctgaccctgtggaagaacca

SEQ ID NO: 2045 - DNA, 156 bp, Homo sapiens
aacttgtgcgcgcagcccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaa

SEQ ID NO: 2046 - DNA, 58 bp, Homo sapiens
agatggaaatgctattggcgggaatatataaaaaaaaagaatcttctgttctgcatgg

SEQ ID NO: 2047 - DNA, 193 bp, Homo sapiens
gagcagcaggtcatgtgcacatgccgttgcagcacaagcttatgcttcccgtagccgtggcttttcattctgcacagtcccaggtcccagctcccctcttatggtttctgtcataatgtgctttatctgattgactccaaacatcccgaaatgtcacctgcagatttctcgtgggaaccaatatgtacatgtt

SEQ ID NO: 2048 - DNA, 196 bp, Homo sapiens
gtctcgtcagcaaccacagcctccacgagacatcatcagtgtttgtagactctctgaccaaggccacctgtgccccacagcatggggccccgggtcctgggcctgctgacgccagcaaggtggtggccaagggcctggggctgagcaaggcctacgtaggccagaagagcagcttcacagtagactgcagcaaagc

SEQ ID NO: 2049 - DNA, 205 bp, Homo sapiens
catccttgcccatcgggaccagaaacctgggagagacttggatgaggagtggttgggctgtgcctgggcctagcacggacatggtctgtcctgacagcactcctcggcaggcatggctggtgcctgaagaccccagatgtgagggcaccaccaagaatttgtggcctaccttgtgagggagagaactgagcatctccagcattct

SEQ ID NO: 2050 - DNA, 239 bp, Homo sapiens
ggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtg

SEQ ID NO: 2051 - DNA, 250 bp, Homo sapiens
aaaagtgaccgccaataacgacaagaaccgcaccttctccgtctggtacgtccccgagttgacggggactcataaggttactgtgctctttgctggccagcacatcgccaagagccccttcgaggtgtacgtggataagtcacagggtgacgccagcaaaagtgacagcccaaggtcccggcctggagcccagtggcaacatcgccaacaagaccacctactttgagatctccacggcaggagctggcac

SEQ ID NO: 2052 - DNA, 257 bp, Homo sapiens
cagggcttgtaaccttacccgtctgtagagaacttctgggcggaggcattgacacctctcacccgctctgcctggatgccaatgtctgcttcaaccagggtgtgcttctgtaacaggtcttccacaccaagtaagtgtttgccatagtcttgagacaatactagcaccttcatttcatccatccagtccataatgtagagcatttcctggaatatcttctgaagccccaggttaatctgaaccgctggtttccgggc

SEQ ID NO: 2053 - DNA, 204 bp, Homo sapiens
gcagcagcagacttgtttagggcctgtttgaaactagcctaggagaggaaaccttcaaagcacggtaggcgtgatgggtcggggaaagctggggcagggagagggccctaagaagcaggcagtaaggggaccagccacgctgatctaggtagattaggcgagactgggcagctgcggcgacctggaggctgtcacgccggtcct

SEQ ID NO: 2054 - DNA, 286 bp, Homo sapiens
gtctacatgatgttgagagccttctatgtggcagatctggacgctctgggtgtaaggcagggttgaaatgtagatcttggcaccagatgtttgcttcagaaaactcacatagcgcccctgcttgccaattagccgaccgactaagtgctttggcacctcgatctcccagatgatgaggtcgaccttcttagggttggagcctgcctgggcattttggaagctctcagtcttcttgagactgcaacagctatccacggaatccatgctgttcctgtcagaaccctgt

SEQ ID NO: 2055 - DNA, 275 bp, Homo sapiens
gagaggatcatttacatccgggagcagtgggccaacctagagcagctctcggccattcggaagaagcgcctggaggaggcctccctgctgcaccagttccaggcagatgctgatgacattgatgcctggatgctggacatcctcaagattgtctccagcagcgacgtgggccacgatgagtattccacacagtctctggtcaagaaacacaaggacgtggcggaagagatcgccaattacaggcccacccttgacacgctgcacgaacaagccag

SEQ ID NO: 2056 - DNA, 197 bp, Homo sapiens
tggaaggagatgagctcccataactgaattggcctttggttcatgttttctccccatatgtatatatgccatatgtgaatatgccatatatatgtgcccacaaatctatctacgttgttcttttcaaattagcacgcagataggaattttgagtttcttcttcttttagtaactagtataacaagcactggtatttt

SEQ ID NO: 2057 - DNA, 286 bp, Homo sapiens
ctgtggtggtctggttactgttgcacacaacgcctggcagaaagccatggacttggaccaagatgtcctgagtgccctggctgaagtggaacagctctccaagatggtctctgaagcaaaactgagggcagatgaggcaaaacaaagtgcctgaaagacattctgttgaagacaaatgctaccaaagaaaaaatggacaagagcaatgaggagctgagaaatctaatcaagcaacatcagaaacttttttgacccaggatgtaggaactggtctctggcccagaga

SEQ ID NO: 2058 - DNA, 254 bp, Homo sapiens
gcacaccatcactctgtagtacatactgtcgagctctgtctacatctccaggcaaactgaaccgtcgcatgatcatagcattcatttctgggaactgctgacaggcaaacaggacaggaccagtggctaacccgagcttcagatcagctgatgttggtttgcccatctggtcagaacacgaggtgaagtccaatacatcatctattagctgaaaagctattcctacattttttccgtactgataggcgatccca

SEQ ID NO: 2059 - DNA, 220 bp, Homo sapiens
agagctgctgcccattgagctggacaccctggtggggaaaggtcgctttgctgaggtctataaggccaagctgaagcagaacacttcagagcagtttgagacagtggcagtcaagatctttccctatgaggagtatgcctcttggaagacagagaaggacatcttctcagacatcaatctgaagcatgagaacatactccagttcctgacggctgaggag

SEQ ID NO: 2060 - DNA, 160 bp, Homo sapiens
tggcagcacctgcttacttaccactcatggtgcaagatgacacttcagcctccgccaaaatgctcaccttccagccagcaggaagtcggaaggagaagaaaggggacagagccccatggcgtccatccttagaggatgctgccacctgaacctctgcttt

SEQ ID NO: 2061 - DNA, 264 bp, Homo sapiens
agggaccctacatctggcatctggatgtcaccctgagcacagaagcctttcccctcactgggccagggacacagatgttcaccaagcgtcactcgcaggagtaaacactgatgccacagttgctccctgcagggaccctccagtgacggctgcagagggcagagttgccggtatcctcctggggcagaagagcaggcgcagcgccctgccccgcgtggtgagcagctcaacctcacactctcaggccacgcacaggcgggagaa

SEQ ID NO: 2062 - DNA, 288 bp, Homo sapiens
gggccgaagtgatgatgtatctaatattatatcctagaacattcacagagtagctgcagaatgtcttgagctggaacatccccaagaggccatatatatatcccagggattttacagtggacctcactaggccggagtaactgtaaagtcagatggataatgagaattcaggacgttagccacacgtggactgtggcaaaaagaaagtgacccactgaagaagactgtttttcagctctctcatcaattgctgtttccaggagcccacagctccaattactcaaaaga

SEQ ID NO: 2063 - DNA, 267 bp, Homo sapiens
tgaaggtcttcagcaaaaatttggactgtaaacacagcttggcattatcagcattctgttaagttcaaagaagagatagttacaacaaatacagcttgctttatttctgaaacaaaactgtgcacatatttgtggccatactactaattaacctgtagattgttcctttcatctattcagcgtgtttttctgccccctgttacaacagtgttgggttacttttcccatatggactatatttaaacagttcccttataggcattagag

SEQ ID NO: 2064 - DNA, 226 bp, Homo sapiens
attgaacagagaatctaccccaaagctgtgagcttaattactctcaagctccggggtcaaagagatctggtgtccattcttatcacgtctccctttttgcggggatggtgcctgttaatttattcagcttcttcgacgcggtttccctttcaataagattgagataaagcatttttcgaaagatctagattgagataaagcattctttgaaagatctagcagtaaa

SEQ ID NO: 2065 - DNA, 254 bp, Homo sapiens
gaagatgtttgtctgagcatcccatgaggtaagcagccccatggaaggaccagctgcatccagcaaagggctccaggtccctgacgtagttgacggtgatggcagaagtaaatctttgtattcttgcagagactttgtttttctgtcattccacagcagctcagcatactctaataaacgtcctcctcttccccttcgtagcattctgggactaatcagggtttcatctgctcacatattgtagcgatgggttc

SEQ ID NO: 2066 - DNA, 259 bp, Homo sapiens
tcaaacgtgaatacaaatccagagtagatctgcgctcctacctacattgcttatgatgtacttaagtacgtgtcctaaccatgtgagtctagaaagactttactggggatcctggtacctaaaacagcttcacatggcttaaaataggggaccaatgtcttttccaatctaagtcccatttataataaagtccatgttccatttttaaaggacaatcctttcggtttaaaaccaggcacgattacccaaacaactcaca

SEQ ID NO: 2067 - DNA, 287 bp, Homo sapiens
attctgcacatttggttctatgtcatttgccatagtcttaaggacgtaggttccataatcatcccttattctgtagaggaggcccaaggttagtgagcagaggaaggttccactgtcgggaaccggtggtcttcaaactcctgtgctcctcttttgatatctttctgctcatatatgttggaaacagcccagcatgagcaaagcaccacctcctagcccccagcctgtgccagccctgcaaagaggaaatatggctccactcagggagcccatcagcgactcaggga

SEQ ID NO: 2068 - DNA, 262 bp, Homo sapiens
tgcattccattccttgtgtcttaaaagcagactgcagtgtagctgaagcaaccttctattcatgccaaagtgctttattctgtgactataccttgtattgagctctaaaacctcagagagctttaaactggttttgcctttatagaaaggttaagtccatttgtgcattacagcttttattctgtgtgtgtgtgcatacttaaattaaaatggaaatttatttgttaggttagtttctcccagaattgctcctggcaaagag

SEQ ID NO: 2069 - DNA, 242 bp, Homo sapiens
tttctcctgttccttcccatgtcaaggctccaaaagcacaagatgcttcacagctgttgtaggtgctccagcagtgaggggaggagggcagctgggcccctgaggcatgggtggagttttcttaagcttaggatcacctgtgccatggcctgaattacctgaaccttgaaacaaccagaatatccttctctttgatttgcccacctgtgatatttactcaatcacttttagaaatggcatcg

SEQ ID NO: 2070 - DNA, 272 bp, Homo sapiens
tacttccatgcatcagatttatgacaaaagcaattatataagcagcaaaggcaaaacccccacgtgtctgtctctgcttttccttttattgctttttttcatgtgggcctctttcaccctcaatcattgctcacttccaagaaggctgagcctgcatacaccaggcccttcaccaccactgccagcgccattcccacgaccacacacccttcaccccagccctgcagaggcagggttcagccccagggcaatctatctggtcagactggtgg

SEQ ID NO: 2071 - DNA, 210 bp, Homo sapiens
ggctcagtgcgcacaactagctagaggcactgactttgtaagcaacaacactatcttcttgaggtctaataattgccttggcaaagggcagccaatgccaacgaggaaccctgtgtacacaagtttctcatcccgaaagtggacactgggtgctcaaaaaatgccttctggtgacagtaacacctgaccagtcaaacaaacatgcacgca

SEQ ID NO: 2072 - DNA, 266 bp, Homo sapiens
ttcctcctcagcaacgggcacaggtcgttccagttttggccaggcggtggcgctcgaggcaaacggtgtcatgaaacggtcactggatgcactgaccctgaagatgctctcaaagcacgagtccgttcatcagagagtggacttgacacccatcagaaacattcccggagtgcgttggtgtgaaggtgcgaggagagtcggggaagcatcccgaagccctgctaggcgaatgggtactgctgagattacagggtcagcacaaagca

SEQ ID NO: 2073 - DNA, 151 bp, Homo sapiens
gtaaaaaggagataggtcacatcatctaaagaattaaaacagacaatttaataacagcattaaattaatagttttcttattaatgggaaaaacggacaggcattagggcagcttagaaataactcaagtttgtataaattccacaactagt

SEQ ID NO: 2074 - DNA, 271 bp, Homo sapiens
tatttttctacaagactgactcatttagtgagttaaagaatatttacatgctttaacttataataggcttaagtaatattcttaatttaagtagaaaaattgtagagggtaaaaaggagataggtcacatcatctaaagaattaaaacagacaatttaataacagcattaaattaatagttttcttattaatgggaaaaacggacaggcattagggcagcttagaaataactcaagtttgtataaattccacaactagttttctgaacagt

SEQ ID NO: 2075 - DNA, 288 bp, Homo sapiens
ttggtgaatatccttgtactgtatattttcatattattggaggtatatcttcagagttcatttctagatgtgagactggtggatcaaagggtaaatgcgtatgtgtggggttttttttagatattggaaaattcccctataaaatggccgtatcagtttgcattcccaccaataatatataaaaacatctgattttccacagccacaccaataggaagtctggtcacatgaaaaccacattctcaacataactagaagacaaagcacctacttcaaattgcctataag

SEQ ID NO: 2076 - DNA, 209 bp, Homo sapiens
tgttcccacggaggtttctgcttgttcccagtaagttgtgattctctgtatccacgtgtctttctccaatttggggggcttcagtttgctctgtgacctccattctctgatggatctaagaagagttgttgattttcagtttgtttagctatttgttaggacagagtgacaactttcaagctccttacatgctgcatcagaaaccagaa

SEQ ID NO: 2077 - DNA, 285 bp, Homo sapiens
agctccacagctggcctaggtttcacaaatttcccactgaactccactgaggtaccctaaatgctagcccagagcaaacttcaggctgggaacccacttttgtcatctctagaccagatggtcccaaaccaggacagcatcccagtggggaacttcaaaaacacctccaagctatccccagtgtttaaaaaagtttcacccttgtagtccatttatctgggaggaggtcatacaggctaactctagatttctttctttgttttgggctggaattctaacagcttc

SEQ ID NO: 2078 - DNA, 254 bp, Homo sapiens
cagaaaccctgggagcagcatggtggagtagaaaagtatgagctgggcattagacgggctgggctttgagttttggctttgttgcttgtgtacttcagttaggatttcttagttgcaagcagcccaaaacagctctggccagcctcaccatgccttggctatgataaaagccataaagaggaatggcaccgctccttgatgcttgttggcagcaagtacctggaattatgctcccaccaagactgcatgcatgg

SEQ ID NO: 2079 - DNA, 252 bp, Homo sapiens
agaagaccagcgacaaatttagagaaacctcggcagtattagaaaggaagatatccacacgacaaagtagagaggagctgataagaaggcgagtgcttaaggaattgcctgatcaagatggagatgtaacagttaactttgaaaattcaaacgggcacatgatacccatcggagaggaatctacccgagaggaaaatgtagtaaagtctgaagaaggtaatggctctgtatctgaaaaaacaccacctctgg

SEQ ID NO: 2080 - DNA, 297 bp, Homo sapiens
gctttagtcctgaatctaatcacatggaaatatattcttgatccatgactgtattgtcaacatatccccatttgcatagtatgatccacttgagagctgagttgtcggcaatatttttaaaatcgccctgaatcatgtgttaattcacactcactaacagcatatgcttgcattaatagcacccgtctgttcaacatcataatcttctaatggtgtctgtaatataaaacttctcttccaaatataagtttcgacttaaagtcagctccttagtatatcccttaccgatggaaagac

SEQ ID NO: 2081 - DNA, 293 bp, Homo sapiens
ttgctccttgggacaactgaagaatccttagataattaatagtatgaaatactgcccttttagttgaaaaatgtcacaataatgtaataagataaataaggaggtgtcgctttaacctgtatcgtgtagtctcctctacttactaacacttacttgtattactagaagcattattttttaaatcatggaaaattggtggcaagctgagcatacagttgtttatttctgtttgactgattattacaacttcattatttgatgaaggttctgtacgttttcctttaagacacata

SEQ ID NO: 2082 - DNA, 257 bp, Homo sapiens
gaattttaacataacgcatgccccttatatttagctctatttaagcaaaatttagtgtcctcttagtatgattaggcttctcaaagttgtacatattctgaacttttcaataaacctttaaaagatttttaatgtcaacttttttaaaatcagtttctaaaaatgagatattctcattgaaaataaatatttttattagtgatatttaaatattgaaaaactatctctgctttttccctcagaatcaaatggctata

SEQ ID NO: 2083 - DNA, 299 bp, Homo sapiens
gagggcacacctgagaagtcattccgctacatgaactctgttattttccttatcccttattttttcctccccttcacatccaaatctttcaagtccgccatcaagtctgatgtgcatcctctttgaaacctttttgaacatcatagacatattttttctcttttctctaaaaggtagcacttcctctttctttaacacatttagcacacaataaatccttttatttattgcccactgttttctaaataacatttattgtaaatgtcattgattatttagttatatcatatgctccttga

SEQ ID NO: 2084 - DNA, 245 bp, Homo sapiens
ccttgtttgccttggtatcattcagcggaggctgcagaacagcaaagattgctatctgttccttcctctggaagcttcgtcccagaggggaatgcgccagatgcctgctggagctctcctgtatgtggtgtctgtcgacccctgctgggaggtgtctcccagtcaggaggcacgggggtcagggatccacttgaggaggcagtctgtcccttagtagagcttgagcgctgtgttgggagatccaa

SEQ ID NO: 2085 - DNA, 289 bp, Homo sapiens
ccttgtttgccttggtatcattcagcggaggctgcagaacagcaaagattgctatctgttccttcctctggaagcttcgtcccagaggggaatgcgccagatgcctgctggagctctcctgtatgtggtgtctgtcgacccctgctgggaggtgtctcccagtcaggaggcacgggggtcagggatccacttgaggaggcagtctgtcccttagtagagcttgagcgctgtgttgggagatccaaggagctggcaggcaggaacgtttaagtctgttgaggctgcaccc

SEQ ID NO: 2086 - DNA, 215 bp, Homo sapiens
ttttccttattttcagactactgtactgcctattaaagttgatttcagacatgcaaaaaaacctggaagaaatgttgcagggctagaaacattcttctcttcctcatagtttacttctacccatctacatgatttgatagaagtgctcgcaggaggtgcttccttaacttcggtgtatgtcatgacatctgtccttttcttgagggccagaacac

SEQ ID NO: 2087 - DNA, 217 bp, Homo sapiens
cctcgctaacacttgtcaaactatattttaactataccccacaataagaaatattttacattcctactcagtttatacacatacaaataactgaaacaaaaactttagaaaaaacctacctatactatgtctgatgcactttgacattttcgattgcattctgttctttttcatcaaaacaaacatgttgcttctgatcgctcaagttgcttttaca

SEQ ID NO: 2088 - DNA, 231 bp, Homo sapiens
gggcccagagtttgctcccagggaatctaatgaaccacctggaatcaaacatttggagagaaggccagtcacttttatcggaacgtcagatggtcatggaccctcaagaatgattgaagaaatttgtaagcccagttaaaacatccacagtcttctttcctcagtgcaaaagttgccctttttgatatctcatatttagagtaaaaaaatttcgttaataagagatcctct

SEQ ID NO: 2089 - DNA, 283 bp, Homo sapiens
tgtattatatgatctgaaccctggggaacatctataaagtggggacgtcccagagacctgcggccttttccacctgagaaggtgcctcagccgattcaaataagaggatgttcctgtgttcccttcccaagaggatctaccaggaacttcagcgacagctgttcccaggacaccctttattttatgctgggaggcatcgtcctccgtggaccactcatttggggttagctgcctgtagaaccgattcctgggacaaacccgttgtcacgtatccacagaatgg

SEQ ID NO: 2090 - DNA, 286 bp, Homo sapiens
acgatcaacggtgtgactgttgggtggttgaattgaaacttaggagtgtatgatgttcatatgttcccacttgatctttctcaggagtgtttgtacatacagcctccctgtctccccttcctccatcccttcccagtcatttctagtaaccactgaacactgtatgaggtggaaagtccatcatgtagtagagaaaaagattcaagcatctcacctaaagttgtctatgaagttttcaaaagcaaatataatgatctccttgtgccagtggacttctttggtttat

SEQ ID NO: 2091 - DNA, 273 bp, Homo sapiens
aatcggctagcaggctttgtttctgcaggcaccacaaactctattccaggagtcttcttgggacaccctattatgaacaaggcatcgctgcttcagagccagggaccccatctcttactgtcggccatgcaacaaaagatcagaccagaaagggctcacctggattgatcacagaagacatttaggctaaaaagtttcagatttacctcccactgcagctatgaccagaccctcatcccctaggcacctggtatctgcccaactgaacttcac

SEQ ID NO: 2092 - DNA, 292 bp, Homo sapiens
ttccaggcatgattgcgggcttacttgctgtcattctatttttcagcaaaactctgggtaggaatgtcggaaattataccttttgaaatccctccttgaaaacatggagatttgtaggtatgcagaggcaattgtaacaatataaagtattgtatctcttccactagagtaggagggcctgactgtcggcccctggggtctgtcttccattacttgtcttgacttccgctgtaaaagcattaagtgggaaggtagcagttctgctgaacaagcagacattgccttctgtaag

SEQ ID NO: 2093 - DNA, 187 bp, Homo sapiens
gaatcaactctatataatcaacaagagaattaggcaaataacatctggttgcactgatggacaaaggacataaagatgttattttcaaatgtcttctcctgaagaaaaatgaaaattgtgtagccagtcaccattttaggccactcattcttgtccagtcatctgtaggattatggtttgagggact

SEQ ID NO: 2094 - DNA, 282 bp, Homo sapiens
ccaggattcttaaatgttaccttctctaactaatatatatggcttgactatctagacttatacttaacaggtatttacatctttgaacacagaacagctgatggagaaagaagcattataaataatatacataaactcagttggtacagataatccgtaattgttaatgttgaacttgtctaaatgctatatgtaatatcttgcatcagtaagataaagtaattatcctttcatatcgttttttcccaccaaataaacaataaaggaccgaaatatcaaggg

SEQ ID NO: 2095 - DNA, 261 bp, Homo sapiens
gaagtcccaggattcttaaatgttaccttctctaactaatatatatggcttgactatctagacttatacttaacaggtatttacatctttgaacacagaacagctgatggagaaagaagcattataaataatatacataaactcagttggtacagataatccgtaattgttaatgttgaacttgtctaaatgctatatgtaatatcttgcatcagtaagataaagtaattatcctttcatatcgttttttcccaccaaata

SEQ ID NO: 2096 - DNA, 290 bp, Homo sapiens
tgctgcaccgcctacaaaatcaaataaagttgattatccaacagacaaagggaaggcacacacaactcctttagtttatactactgtttctgattactaaacaggttctgaaactgtttctgattactaaaaccaggcttagttagggacttttagcatcagtattcctaagtggtcactagtagttaaaacactgcctgtctagaaaaaagaagttgagtatcatccactctgtctgaatgcttataccctcaacaaagcttatcaaaatgaggtcaatcccagaaata

SEQ ID NO: 2097 - DNA, 296 bp, Homo sapiens
aaaatgaatctactgcctcctccgaagctagtccttcagatactagaagacaattatgccctctttatcaaaggccctacttaaaccagttcagtgataatctatcttctatacccgtttttcataaatagaaccatgtgttgtttcttgcataattatagaagtgttcaagagaaacgaagagagtgagtggcaggaccatggtgtgatgcaggaggaagagctcttggctagaatctgctcccaactctccaactaactgtgaatcattgaattgttacttaatgcctctataa

SEQ ID NO: 2098 - DNA, 287 bp, Homo sapiens
tgaaatatacaagtgagttcaccaaactcataaaaatgtccttaaaatgataaaatggagaacttgggggtcccaacaaagaggaattaaggcctggatcatgattacctctgttttccatgtgactttgaaagcagcagggctggagccaagttggccctgctccctcctagggacagcagggttgatgtccacctccatttccatttgcttctgtccagccggcaggcttggcggcccctcctggctctggagctttaatactttcttattctatccgatcagcg

SEQ ID NO: 2099 - DNA, 248 bp, Homo sapiens
tttcaagcaaaccacatcattacccacagaggccattggtgagatatttgtaagtctcctgacagtggctggagttcgttgcttggtagtagtttctctgtctcagccctggagatgggagtgaccacctgctctctctggacagaggctgtccacgttcatgcaattccttggacaccggtggcgcagcgggaggcgtaactgggagtgggagaccctgaactgtgccggttcttgcagagtatcac

SEQ ID NO: 2100 - DNA, 263 bp, Homo sapiens
gaaacagtctcgtacatcacggttcatttttaaccttttttcttaaattttagagatggcatctcattatttttccccaagctggactcgaactcctgggctcaaggaatctcctacctcagcctccccagtagctggcattacaggggtacaccaccatgcctggcttagtatgtgatgtttttatgtgtatttaaaaaagactccttaacttcttctaagtgacctgtgtgtaggtgtgcctgtgtatgaactctgtccaa

SEQ ID NO: 2101 - DNA, 288 bp, Homo sapiens
gacaaaagcctctgaagtaggcattattccattttacagatgaggaaactgagctttatcatgcttaaaagtatgtattgctgtcttggggaaaaaggcaggatatgactactaaataatgaggttaactgcctaggaggctcatacactataaattcaccttgaaaattatttatgggcctcaaatttatgttcctgggaaagaggagcaaaagattaaatcatttttattagttcagtgacaattctaaaaatgaaacccagaaatgtactcactcctaaccactc

SEQ ID NO: 2102 - DNA, 288 bp, Homo sapiens; identical to SEQ ID NO: 2101

SEQ ID NO: 2103 - DNA, 241 bp, Homo sapiens
gtatccaggcagaacggtaccctgagggccagcacagcaggaagaaagacaaggacatgtgtactgccctgcattccaggctggaggagtcctcttaaataagagcccagaagtgtcctggggcagcagctggaggctgatatatttcagaggctgaaattaggggaaaggagaactgtactgtgctttagattctttaaaacataacttcccttcttcatagccaagagacaggaacgga

SEQ ID NO: 2104 - DNA, 278 bp, Homo sapiens
gattcagtgggcaactgtggcaatagttcttggctaacctggtcactatggaagttctttccgtggaaaaagattctccatccttcaatttgagataagatttactaattgagacctcatttgtatctgattttaatctttgcatcattttagttttaataaactaactttccaacttaccagattttcgggttgacaaagaccattatttagagaaacacaggcaaaggaaagtctaaaagctttggctggaatttcaactgcttctggtccagaat

SEQ ID NO: 2105 - DNA, 273 bp, Homo sapiens
ttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctcc

SEQ ID NO: 2106 - DNA, 296 bp, Homo sapiens
tagcccctggagagcatgtctttttctctatgttgcctcactttatttctgagaaaatagttgttacatatcatttcttccaagtaactcaaagtgcaaatataaatgtgacaaatcggggaaacattccaaattaactcattttaatcatagagtcttacagaaggaagtaaccaagatgtcactttctccagctttcctttctgagcaatccttcctaaaatactcttgaaagatgttttggcatctgtgtgacatttctagctattagatagctctagctagacagcttctcc

SEQ ID NO: 2107 - DNA, 246 bp, Homo sapiens
aagcaacgttgcacatcagctccacttggacatcatgagtatcacgctgagcatgagcttgcaccagccctgacattgtgggacatgtgactgccaggcgcttgtgtctcagctatgacatcagaagcccctctgcagggtcagaacgacagttgacatctgggtagccaattcctgggtgctgcctcatctagacaccacagaggcccagctcctttaccagcctcggccttggcatagacatca

SEQ ID NO: 2108 - DNA, 223 bp, Homo sapiens
tcaggatggtacgtggttgccagcagagagctgctcctcaagtgaaggaggtagaatcaaagccaataggaaagagcctcagatgcttatatatgtaccgtggggattcagagtgaaagcagtcattggactaggggtggggttagggagagcctgtctgacagacacaagaaagggatggatacgccacccagagaaaaaagcattttaggcaagaacaaat

SEQ ID NO: 2109 - DNA, 252 bp, Homo sapiens
caaaaattcctgcatatacccactcaggaaatattttcccaaatcttctccatctcaactctgtgaggcattggaagaggtgcttttaggcatagactgatgcactctatatatgatgtctcgccctccagggcagcacacagtttagtgaggtaaatgtctcatgaatattccacaagatccaccttgataatgctctaacgttactcatagagggctgaatgtggaaagatgctttcgtctggtggcaaa

SEQ ID NO: 2110 - DNA, 279 bp, Homo sapiens
aggactttggtaacagaacattctgtcaccattaacttttgcttgacattggattatttctaaatacagtttggctgtcttctgatcggacattttcagaggaaatgaagttaggttaaacaaatactacgtgaaaggctacatttgattttgacagccaagaatgtttcctgggtatggagttttatgaagaatctcctatttgctctggttaatttgatattgcattgcccatagttacagagtacagtccccatctgtacatcacctacctatttc

SEQ ID NO: 2111 - DNA, 280 bp, Homo sapiens
aagcaacaagtaaacacacctatgaaagcaacttgtttgagctgtctcaacttctctgcagctgttctggctgtatctgtattctagtacttctttgaactctagagaaaagtttgttcatcaaaacctcatgaagtttaaaggtagtctattgccttttgtcctttttcaaaaatcttatttctttatttaaattgacaggtaaaaattgtatttttatgatgtacaacatgatgttttgatatatgaatacattgtggaatggccaaaccaagcaacc

SEQ ID NO: 2112 - DNA, 254 bp, Homo sapiens
ggtgtgaaccgctgtatccagcctctttttcaactaacatcttatctgaggtataatatccgtatgcaaaaatacaaaaattccaaatatctaactcaagaattttacaaagtgagcacacctgtgtaactagaacactggtcaagaaagagaacattcccagcaacccagagtatctcttgtgttcctttccgatggctttccaaaaataaccattgttctcacttctaacatcacagattattttgcctgtt

SEQ ID NO: 2113 - DNA, 275 bp, Homo sapiens
tccatagtattttaagctccgtaaggaacagggacctggtctgtctttataccactgtacaccaagagcgcaaatggctgtgtgctcaataaaaacttgtcaaatgaccacaactacccaggtaatttactttaaggtcaccaagtacacataagatcaagtcaccaccaataaatcagtaagtccaatgaaacagtaaacacaaaataaattattactctgttcctgggtaaaatgatcttaaattgtaccagctttcagcttggaaggtttga

SEQ ID NO: 2114 - DNA, 261 bp, Homo sapiens
atggatgaatgtgtggacgaatagatagatgaaagaatggatggatggataaatgggtagatgaatggaatgggtggatggataggtaattgtactgatgggagaagacttgtcttgctcccatcagccccctgagtagctggggttataggtgcacgccaccacacccagctaatttttgtaattttttgtagagacagggtttcaccatggtggccaggcttgctctcatactcctgacctcagtggtctcctcctcac

SEQ ID NO: 2115 - DNA, 255 bp, Homo sapiens
atggatgaatgtgtggacgaatagatagatgaaagaatggatggatggataaatgggtagatgaatggaatgggtggatggataggtaattgtactgatgggagaagacttgtcttgctcccatcagccccctgagtagctggggttataggtgcacgccaccacacccagctaatttttgtaattttttgtagagacagggtttcaccatggtggccaggcttgctctcatactcctgacctcagtggtctcct

SEQ ID NO: 2116 - DNA, 273 bp, Homo sapiens
atatacccaatgtcaaatcactttttatgtatacaccaaaaaggcactcaatattaggacctatcccatatccaggcacacagtagggaaccgtactccaaagtgactatctgctaggccagaaaagaccaagataaccttgttagtctccttaccacttagaaatattgttatggttttagaatctatttttacaaaaatggttttctctaccatatataaatccatgaaaaatattgatgttaatattctttcattcctgagtttagtcaa

SEQ ID NO: 2117 - DNA, 293 bp, Homo sapiens
gtcaggctcacatctgaaacatgtttaaacagctaatggagctgagcaactaaaagctaaatgagtttctatgctgggctgcctatgagacaaggtcacaatagttaccaagtataataactattattaagagaccctggcagtcccaataaaagtaggtcctaaaaacttttaagagacagaaagtggctggaacacctccatgccgtggttgaccaaacatatttctagcacaagggagactgcaaaccacaatgagactcaatgagaccttcatttaatgtgggacacag

SEQ ID NO: 2118 - DNA, 268 bp, Homo sapiens
gtgtatacaaagctcttagcacagagtgaagctcagtgaacaaatggctcttcttatgaagagcagccctcagcggaggcatggcacctccttcaagagaaccaaacttggaaaccttgaattaggaagtgattactcactttacagggaatgactacggtaatgatatatttgctttctgttacctaaacttagcagcttacatatttatcatctaatggtttctttagctcagaaatgtgggcatagctttatgggtcctctactt

SEQ ID NO: 2119 - DNA, 271 bp, Homo sapiens
tgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtacttacacagtgg

SEQ ID NO: 2120 - DNA, 272 bp, Homo sapiens
acctcttgagcgcttttctatgaagcatcctgtttaagcctcgcacttctgtgatgtggaggtgcagtaattatccccatttcacagacaggatgttgaggtcagaggggttgagtgattgtcatgggccaggtctcagccaggcttgctaaccctggagtctggcgtctgctctgaagtggtcctctcagctggagactgacctggccttttgcttgtgatgtcggccttaaaaattttgggggatgctctcggacttttggatgggttca

SEQ ID NO: 2121 - DNA, 220 bp, Homo sapiens
gggactaatgtagccttgcttctgagatgtggcccctaggtctctactgaatgcccggcatatttaattagatctttctttcctctatggcctcaagggatttcaccctaagtatgcacaaatttttattcagccgaagactgtacagatttctggaggcctttctttgtgtacctccttcgtttccagtagtctgacccataaattgtacagatttctg

SEQ ID NO: 2122 - DNA, 281 bp, Homo sapiens
tcttgggaagactcataggccttttctagtagaatcttacctagcatcagccctcataaatttgctgatgtaattttaagttatactttctagctgctggaacacgcatgagcgagtgtctatcctatttcctcaaagttgctcaacttgcttaagaaatacataactgcatattggacatcagaagtgcttggttctagctgggggaaaaggatggttaattcccccctaaagcatcattgttttgcaatcgagtgaatcggatggattctccttcccag

SEQ ID NO: 2123 - DNA, 241 bp, Homo sapiens
gaagacaacaacaggtaaacgagaaaatccttggaaaagaacaccgttaatttacaatagtatatgtctctctctggccaacgtactttgtttcatgacactactggcatcatccatcccaaatactttcggtcgctgtgtgtttcagactctgaaaaaccttcaaataacacaataaaacctgctcctcttttcctttaatcttacataaaggcagttctcttaagtctatagtcaaagc

SEQ ID NO: 2124 - DNA, 242 bp, Homo sapiens
taaatgaagacacctaacggtttgaaaccttctggctctgaggagaggaagagggtccccagatacaggtttcaattccttaccatttagtctggttccattgatcaggggttcagttttctcaccttaaaataagaggattagaacagataatttctaaaattatttttaccaccccttttctcttttctttctttaattcctgtggcgttctctgcagtttatatgtccctaattttatg

SEQ ID NO: 2125 - DNA, 252 bp, Homo sapiens
ttggcagaactttctggcttttcccccttcatgttacgtgggtcattgaggcttggctagcaagcgtcactatgtgttcagcctcacggggcggggatcacaggatcacggggatcacgaccagcgggaatcacagcggcttgccagtgtgtgtgccaggtggctagccctcggtagggacagcctccctgactgtgcgtgacaaacccgaagaggtagcaccatccccactttgtaatgcctcctggtcaa

SEQ ID NO: 2126 - DNA, 280 bp, Homo sapiens
ggcttaatgtgatttgctccataacactgtgccaatgacatttcatcagggttggcaaaattgtgaagaaaatatttgtattcagggtcaatagtgtgccgggtcacaagaggagttccaaacttcttgtttgcctcttgagaagtttttcttgttgagctgctggagtaaacactcattattatttttattaacttctacctgtgtggcttagtccaggaagctgcccaaacactattgagatggagttgttttgcttctcttcaaatgtttatctttt

SEQ ID NO: 2127 - DNA, 251 bp, Homo sapiens
aagccaaagacgatgtaagtttctaaatgttatttctctccactacttaggagtttgcaagtgtttgtgtgatgatgggctttattcagaaagttcttcatgtaaatgatgatcagtgatggtttctatcactgggctccagtcaccagcactagaaggtgtttggttctgtctctagaaggcagtgaatatgatctcactgtccctttgccgtggcaggatcccttaaagtcgatggaatctttgcctgt

SEQ ID NO: 2128 - DNA, 246 bp, Homo sapiens
ccagtggacacagaatggaaggactgttcccagttcggttttcaatcagcagcaggcatgccttccagcaagcacacctcatctcaatacgccttcctgggcacttaagttcaggggtggaaacagctgggctgaagggggcttggtggtctactgcgaccagctccgtttcaaaggtgggaggactgaggcccaggcaggggcaggaatcccatcagatttgggaaaatacagggcggcttcctc

SEQ ID NO: 2129 - DNA, 266 bp, Homo sapiens
tgactgatagctgccgcttatggttacttagtaaaaactcctgttgctaaatggctcaaatggatgtctgtgtgtttattttgccatctaatacaaagcataaatttttcttactccagtagctcatcaaacccttgaatctttcatcataagcacattgaggcaggaactatgcctgtgccatcctcacacctttgcaagtggcactcaataaatgtttctcaagtattgttcagactcagtgagggtcacatccccaggaggaa

SEQ ID NO: 2130 - DNA, 257 bp, Homo sapiens
tttttccagggctctaatcactactctgttaaattcctcaaacttgtaatgccccaaggcttgattttttccagataatggctctatcgttgcacataccctgattctgtcaggatgtgtcattggcaaaagtagctttctctgccaaagctttctgaccgttggctccatcttagcgttgttagcaggaaaggcctgctacccagagtcagagtcaatcagagaatagttcatgtggtccttagaactttactcct

SEQ ID NO: 2131 - DNA, 288 bp, Homo sapiens
gatgtcaagaccactacctttaggcacagaacattctactaagatttccatttttgtgtaaggttaattttaatccctaggatttcaaaattctctctttcaggatcctgctcaccctatcttcactattgcatacctgaaacttcaaatcacctctctctataaaaatttaagggtggagaccacagtcattgcttcaaaggcatcaaagtagaacatatctagaagctaactgcatttcaaccaaaatattgatgaaaatttattacaaactagtctctctccaga

SEQ ID NO: 2132 - DNA, 282 bp, Homo sapiens
gttctttattaccagcttgaatgggcaatgccgctaaagattttaaggcagatttaagtagttttcaatttgagtaatttttcttgctttggcttttcacaggtaatggtaactcgggatttgaaggacagagtcgctatgtaccatcctctggaatgtccgccaaggaactctgtgaaaatgatgacctagcaaccagttgggttcttgatccctattaggttttcaaacacacaaaatgaatactaggtaattttcagtctttatcctgaatggaacaga

SEQ ID NO: 2133 - DNA, 96 bp, Homo sapiens
atggtaactcgggatttgaaggacagagtcgctatgtaccatcctctggaatgtccgccaaggaactctgtgaaaatgatgacctagcaaccagtt

SEQ ID NO: 2134 - DNA, 277 bp, Homo sapiens
ctgtgttcagcagtgggtttacatgggtgaacatgacagcacctgctctcagggagctcccacccctatcctccattgatggagaaaacagatgagactccagaccaaggaggagttggtggctcccaaagaaacagtggagcccaggggatgaataattaaaacgtaaagcacatcccagagctcagcactttgaaggtgtttatgtcccagctctgaaaaagatgttctgtatttcatctctgagtctgagattctaaaagctatggttggtaca

SEQ ID NO: 2135 - DNA, 259 bp, Homo sapiens
taccatgatctctttgtgcttcctcatctttcattggcaaatctctggaatgggccatataaatgcagccctcaaatccttaacagcttatgattcggcttccatcactcacatttaagcttttcttaaagatcactttccaccatcatcaagaaacaactgtagtcagttctcttgtccttccatttcttaggactatcaaaatattgtgatttgatatttgactcaccctacttctctaaccttgtaccgtcacagt

SEQ ID NO: 2136 - DNA, 258 bp, Homo sapiens
tactcctcatggatcatacctcgctctcctcagatgttttaatatatccttgagatggggtcttgctgtgtcacccaggctgaagtatactgagtggtacaatcattgctcactgctggccttgaactcctgagataggaggcgatccccccatctcagcctcctaaagtgccgggattacagacgtgagccatcgcatccagcctggaagtattttgaaggttcagtgtgaggatttgctgacagattgagctggag

SEQ ID NO: 2137 - skipped

SEQ ID NO: 2138 - DNA, 288 bp, Homo sapiens
atgacttcaatgacgaatcctactggcataacatctatggtttcaccaactcttagcagtgatctttggttccagattcatgtgaaaagccaagaaccgctttccacaatttgtcttgtcatgactctccggctccatattttaagaagcagtctacactagcccttgaatctagactctaattttttaagatacaaaggaaatcattaagccccggaatattagtagaatatacggcaatatggatcaagtaatccaaagtattagcaatggtgcaagaggctgtca

SEQ ID NO: 2139 - DNA, 269 bp, Homo sapiens
tgcagtaactgtgcgcctattgtaaaggcaaatgaagctcacctattccctgctgggatcagaagtgacctcaccaccccccatgcctcaaatccttcccttgccaacctaactcaatgccattgcagaatgacgaatgagctcagaaatagaccccaagttactaaccctgctaagaacagcaaaagcctttgctgaaatgttttaaaaatgcatagggagtgcagctggccagtaaaaagcagggagacaaattccaatgaacccaa

SEQ ID NO: 2140 - DNA, 290 bp, Homo sapiens
aatgttttgtgcttggattgagtttagagacaccagatagaataagattggcaacactgttagccacctgctgaccacagctaaacaggcatatgtgcttctgcatggggaatgctatggcgttaacagagccttccttaaaacctgtaagttcgttaggcttccgggtaccagggttgttagagtaggccacagtttacttcctttttcataagtgcttttctttcctggatctcagtataggaaggaaaatcagacagcatttctcaattgttgacgcgtaagggcca

SEQ ID NO: 2141 - DNA, 230 bp, Homo sapiens
gataaatcttcgtgaagtggcagaaaatatgaaagccagccaattggaatcttgcttattctgatctgttatctcaggggttagattcgcgtgctgaagtggtctacgtaacttccatagcgattgggaggtgttctctggtggggtagcagttctgtgttatgacatcacacatggaattcacggggaggaaagctgggtataggcattaagtgcccagtagagcaggt

SEQ ID NO: 2142 - DNA, 276 bp, Homo sapiens
atgtgagagtgctttgcagttggaaagtgctgtaggaaccctgaattcatctgaaactgtagcttagtgtttaaatgatgtctgttattacttttttgaatagtctggagtgcttgttaaagaaaaaattattctgtgatatttgttgaatgaagcacagtgaggaagactttactcagggcccttgtaatagctatagggaccactgcaatagggtcttgcagtgggggagagagaataggctcaattctgaatacatcatcatgggcaagtggg

SEQ ID NO: 2143 - DNA, 245 bp, Homo sapiens
gggtgcagcacaagttccttcataggactttaagactctttgggatctagtccctgcgtatctctccagttctccttaccattctcctgtatctgcctctggctgcagctgtgccacagccagactctggaaggagcctcttgctgtcaattatccaacaagtgtttactgggtacccacttctgccaggcactgggttagaggttggagacatagcagtaaagacttgctctagtggaagacaa

SEQ ID NO: 2144 - DNA, 266 bp, Homo sapiens
gcacactcagtgactataagcttcctgagagcagggctgttctgaagagatttgagttttctcctggccatggagagtgtaattaagtagccctgggcccttgaagacttatagtgcaggttgactgaaagaactaaatcagccagtctttgcggagaggttgtcatgcaaacgaagtgctaagggtcttgcatgcatcccttcattttatcctcacaatagactgtgaagtaggcaccgccatccctgttgtgcattgtgcaggc

SEQ ID NO: 2145 - DNA, 287 bp, Homo sapiens
aatgtggcatgggttccaaagctctgtgattttcctatactgaaagatttctcccaaccatggaggagcctaacaattcagtcttcagggtctctaacagcactgacacactggatgttaattacattgtgattggagcttccttcccagacactccagtgtactactttcctcctttacagcctctcttctaactgccaataaaagagtcctcatgagctcagctccagcacagataagactgacagaaggttccgaggttggcatttgcaaaatcgcatgagcat

SEQ ID NO: 2146 - DNA, 287 bp, Homo sapiens
atctgggaagattcttagaacctataatattaaacatttctgtagcaaacatgattatttgctctaagtggaataagtaaagatttttaatagcgtcacgtcacttcaagttatgacactaaatgcattttggagcgaaacttacaaaaaacaatatttttaaaactttctggattttagacttgtgagtaaagattagattttatataaatcgcattgtgagttagggagtgcttaatggactggccttggaagccagtcagtatttatggcaagtcagtgcgtat

SEQ ID NO: 2147 - DNA, 257 bp, Homo sapiens
gaaacagtacttggatccacatcttagtcaaattattaaaatacagcagacaaggacaggatcatagtcctcatctttctctcttcccccacattaatacattattatttcaatgaaatgagccaaattttaaacctaaactacttatgtactcttgcaaattttctgataatttttaatataaattcaaaacataaattcattttgaagttggaatttgaataaactcattgtggttcaaataagagaccaacgac

SEQ ID NO: 2148 - DNA, 252 bp, Homo sapiens
tgctgtgttagcaactgacgtacaataaagttgaattcacccgaatatctaagtcttaaaagataaatgcaagtagctggtagctgatttaggcaccagtaacagaagtgaacacctaaaaagtaaatgctatcacaggtaggaacatgtgagtgaccctgattacttgtcagtaggaaaagatgtggagtgcaggcatattctctttctactttggatcagcaatcagattcactcacagatcatcgattc

SEQ ID NO: 2149 - DNA, 288 bp, Homo sapiens
ggcttaaccagctagacattcctctaaatacatacgtaacaaaaattgatggcaggagattttattgggatcactggatacctacactcaacaggcagaacttggctaattccatttataccactactgagacagtgaagacaaattaagaatcagaacaggaagcacatagcatagggatacccgtgtcagcgacatatttaatatgcccctcagcttaagactcaatactgaacagaccaaaaggccacctcaattgccgctcccgccacacttgctattgaaact

SEQ ID NO: 2150 - DNA, 284 bp, Homo sapiens
ggtgctattgagttccatcatgtccttactgattttctaactgctggatttcaccatttctgatggaggggtgttgaagtttccaactataatagtagattcatctattctcccttgcagttctatcagtttttgcctcatgtattttgacactgttattaggcaaatacacattaaggattgttatgtcctcttggaatatttcttcctttatcattatgtaatacctctctttagccttgataacttttcttgttatgaagcctgctctatctgcaaggaac

SEQ ID NO: 2151 - DNA, 259 bp, Homo sapiens
atgagaatatccagcaaaccagtcctaaatgactgattactgaagatcagatataactaatgacttcagtagttgaggtcagtattaattccagcatttttagcatagacaggagaaagggaaggagatgatcatattatcagtggatcctgtgaagactaaagaggaaaggtctgtagtgatttagaatctgagcaggtctctttggttgaaaaactatctaggttaactcagcgtacactagcctgcagccttctga

SEQ ID NO: 2152 - DNA, 278 bp, Homo sapiens
tagttcaaagcaacccatcgttcttgcttacatctgcatttcaaaccagctttaaaaacttaagtggattgattagttctaagttattcttgcccagactttcatatatttccttgactggctactggattatagtattccgaaccctggccagcttaagattagagtagatagcaagaagacttttcttctgcaacagctgttaccgagtttagaagccctttagacttgttccgagggattgtgctcttacaggatagatccctggattcccactc

SEQ ID NO: 2153 - DNA, 249 bp, Homo sapiens
agaagagagtaacccggtataactgggaccagcttaaaggaactgctttccataacattctccaactaattctacactagtgaacaagcacagctggtcctgggtaccccagtgcctagctcctccatgcttcctatggaacgtgtggagactcagtgaggctctggagaggccagcttacaatgtacacacccacgttctccaaacagtcactgtgtagcttataacacaacacaaaaattctcggaa

SEQ ID NO: 2154 - DNA, 290 bp, Homo sapiens
gagccaccacgggtagcaaagtgaacttcccccgaatcacggttaagccccctgggccacatggagctgtcatctgcagtttttcccacctcggaggcctgaccctgtgctctccataatcaatgagtagatgtggccctttatgttccctgaggcttccctgactgctcattaaaaggatctgctcagtcctagtgaattgatttactttgccacagtccttgaaggatgctacagatcaaaaggtgtccaggaaagtgatcttaaagatgctgacactactcccagtt

SEQ ID NO: 2155 - DNA, 289 bp, Homo sapiens
cgcattgcgtgggcacaggaatctcaatagctggccccagagcagaagcagagaaggtgtgaaggcctggactcttctgagcttgaggtcaggggatctacttgcacattagagttatttaaatgaggaaaatgcatgccctttttgaatcgatgttgtcaagcctttcttttcctaggagaatctttcgattcccagcatggggaaagcatgttttcaggtattaaaatgagtaaggttgtaacagttaccatgaatccacatgttgtgccccattctaaatcaagta

SEQ ID NO: 2156 - DNA, 226 bp, Homo sapiens
atcctttgattggatctagcctccagctcaatataccttcctcaattggcctacaagaagaaaaagatctgaagctcagcataatgctggctttagccagaagaatccagcctttaagccatctatatgtgtagccatgaaggaccttctaatatgccttgtgagcccttatggggccacctcacagccacaatttatgcccacgtgtcagcctcacagactcagg

SEQ ID NO: 2157 - DNA, 267 bp, Homo sapiens
ttgttatggagcaggttcagtaataagagttggtgagtattattcagaagagaagctgcctcttgggttgagtaattaataaagtgattcattgggaggtagttttttgtctgtaagaatctctaaggaatgatcacaatgataagttttaggacatcccgttttaaaaactggactcttacaaactttgttatctagatagcattaggtataactaaattggggagacaaaagtgaaaaacgattaaccatataagggtggtttca

SEQ ID NO: 2158 - DNA, 279 bp, Homo sapiens
ttgttatggagcaggttcagtaataagagttggtgagtattattcagaagagaagctgcctcttgggttgagtaattaataaagtgattcattgggaggtagttttttgtctgtaagaatctctaaggaatgatcacaatgataagttttaggacatcccgttttaaaaactggactcttacaaactttgttatctagatagcattaggtataactaaattggggagacaaaagtgaaaaacgattaaccatataagggtggtttcacaatggcacgtg

SEQ ID NO: 2159 - DNA, 264 bp, Homo sapiens
ttttctctaaacgaaggctttctgcacaaaaggtaaaagaaatccaactgtttggcccatttaaaatcaagtcactgaagtttctctgagctcaatcacactcttcatctctgaggttcatctctgttcttaccacatgataacgtgaaaaaatagtttcttaaagagctggccccatcatctccagaaatgatgttagggaaggtccgtggaaggcacaggcctgcagtactgaaggcagaggcataactgccaaccacaatg

SEQ ID NO: 2160 - DNA, 276 bp, Homo sapiens
gtagcagaagcaggactggaacccagaacccaagttggaccactagactggtgcctctccctaagcccactctgcctcttccatgtctgtgaatgagcttaccactcctagctatgcaaaactgcatagaaccatttcagcaagaggctcaggtagcattaaagaagttcccacctcaacgatgtcaattttttgttactgttgtcttgaggaagcatgtttgcttttaaacgctcccaaattaaaagccattctcagccttcctacaattgtatg

SEQ ID NO: 2161 - DNA, 238 bp, Homo sapiens
gcctatgttgtagaatccctcgtacccagagtgggagaagattacacccggggcactgcagggagggaaccaggagagatgaagtagtaagctgaggcatgcccttctggccaggctggcgtctctgggcatggccacatctgttcacagtctgagacttgagtcctggggtcacacaagggcactgggtaggagatgtctatcttgggaggaggtcttgggaagcaaccacagatag

SEQ ID NO: 2162 - DNA, 234 bp, Homo sapiens
aaaaagcaatttcaacatggagccagtatggagagattgcaagattacctagaaagttaccaaaaggctatgctctggaatgtctttttatattccaacacttcaatgatggaatggtctcttctcattttatctaacaacagtttagttttataaagaggtatgagctacatttggctttatttcctataaatctatgaacgtcttcaggacacatgctgactttctgaggca

SEQ ID NO: 2163 - DNA, 296 bp, Homo sapiens
acgtctttcccgctcactgtagctgccacccattctttttaatccccagagagcatacagatgagccccagtgggccatctcagccacataggggacaggccggggagaggatctagagctggcccaggaaaggaggcccttttcattttgagggaggcctcccatcagagaagggtccagtcctgccccgaccctgtccttcccatgatacccacaatcccagggtgacctgtctccagggcagaagtgacagacgagggctaggagactggctgaggcctaagtcctctgcaat

SEQ ID NO: 2164 - DNA, 277 bp, Homo sapiens
gatgccacagcagatgtgtcaaaccatttttcctgctcatggcatgtagtttgagagagcttgatagtgaagctgccagctcagctgtgactggccactcatttgcagactagaatgccttactggcctgggcttgcttaaggtaattgcttctagactcctcactcctgctgggccacagttgcttgaacagtcaaataaggggttggggggtagaggatatatctcaaaaccttctttgtgcttgaagatttgtgattccttgttctttggagaa

SEQ ID NO: 2165 - DNA, 34 bp, Homo sapiens
gagagaagtgggaagcactagacacttatcaaac

SEQ ID NO: 2166 - DNA, 105 bp, Homo sapiens
gagaagtgggaagcactagacacttatcaaacaaccagatcttgtgagaacccactcactatcatgagagcagcaaggggcaaatctgctcccacgatctaatca

SEQ ID NO: 2167 - DNA, 273 bp, Homo sapiens
tgccctgaggccatctcttttagaatcttttgccagctggaaaggctgggaagaagaaacatttttattctccacccagtacatcctggattggaaatagttcctttaaattctgcttgaaaatggaacagttccttcatctttctcttcccatgtgttaccctaggcagcaaaaagaagccagcttcctcctggaccccttagccagatgcaggagttcccgggggaggcactccatcctccctgtcactgagggtgaccttctttccactt

SEQ ID NO: 2168 - DNA, 291 bp, Homo sapiens
tcacccaagggaccacactgggaaacccagtagttgtctcggccatggcactaagacctttgcaccctggccatcttgttccgggacagccagcatctgtggtgtggtatagagacaaagctgccacctccaggacacttgctccttcctggccttcctgctgccctgaaacctgtggcctgtgtgttagtggaaacattctcagtttcattgctcagtaaaccttaggttatccaaactgcaaataaaatgttctctactttctagatttttataacttgctattttgag

SEQ ID NO: 2169 - DNA, 294 bp, Homo sapiens
tgagcagtgtttcagcgcccagagagacactgtggagaaggtccaccaggatgcctacctgccttacacaagagcctaactttggcacacctgtggcacacctgtggagagctgttctggccccggttgtctggcaggcctgggctactccgagcagggtaactggggcacagaagctgcacctccggctataccctggtttttccagttcctgatgcccgcccctcaggtggcagcatgaggtgactcagggacagacgcacttatcgtgacgcaagtccaccctgtcgagtg

SEQ ID NO: 2170 - DNA, 282 bp, Homo sapiens
tttcttcctactccagggatctcctcccttccccagggttgaagcaatgcacactgaagtattaatagtagtgatcagcaccttcaagacagcaggacccttctgttgccttctggctgtggtgtgatgtcctagggcctgtggtgcataagcaggtggaatctaagcactgaccctggtcattctacatataagaggaagaggactaggaaagctcgacaaatgctgttctcctcttcatggcaaagccttgctctttggaatccttatctgcatttaaaa

SEQ ID NO: 2171 - DNA, 199 bp, Homo sapiens
cgtcctttatgtggcacacccttaagggagacatcttcctgtctgtgtattgcaccctcttaaaactacattcctttcccttcagcattggcatctctgtccttgtgtattacctgggatgactattcagttaacaaatgctttcttcctaggctgtgagccccagtttgttggatgattggatggaggctatcagcgc

SEQ ID NO: 2172 - DNA, 246 bp, Homo sapiens
tctacctcagacattcccattctaaatatggtgggcctgacactgcaaaactgctaaagaagttccacacaaaaatgtgttttagctttaattacttattcagtttaaacaaaaaagaatttttttaaattaccagctcttttgttttcagttctcataaatacatctggtttccccctctctctctatctgataaaagtattctgaaaggcagagtccggagtgccgaggttagaggatctagaa

SEQ ID NO: 2173 - DNA, 257 bp, Homo sapiens
ctaagaatccttctacctcagacattcccattctaaatatggtgggcctgacactgcaaaactgctaaagaagttccacacaaaaatgtgttttagctttaattacttattcagtttaaacaaaaaagaatttttttaaattaccagctcttttgttttcagttctcataaatacatctggtttccccctctctctctatctgataaaagtattctgaaaggcagagtccggagtgccgaggttagaggatctagaa

SEQ ID NO: 2174 - DNA, 291 bp, Homo sapiens
gtgaaataagccactgaccagtaaacaactgaggcttaaaccagcatgccagctcaggtggggagcccccagcactggttatattccctagattcctcactggataggaaagttgggcctcaggcactcttccctcctctgcagtcaaacagtgcagatgaagagccaggctctgttcccagtgctttatgtgctaacttggttgataatgttatccattctcattttgtagatgaggaaacaggcacagggtggtcaagggacttgttcaaatcactgatcccataaggg

SEQ ID NO: 2175 - DNA, 295 bp, Homo sapiens
actactccagatttttcacctgcaagtggtaagtcaggccaacttccgttggtgacccgttatctctgcttgaaaaaagataaggagattctccactttggcctcagctcttagctaggttctttagtccagctaggagttactgagcctccaccaagaaggtgaatcatttgacctcatttagctcctcctccttatttatctttattagagcttgcagtgatggagagtaagtgattgggacctcaaacttctaacacataattctctcaggcgggtttggaatggtactcta

SEQ ID NO: 2176 - DNA, 253 bp, Homo sapiens
gaattgtgtttgttcatccgttaaatacttactaagctcctgctctctatgccaggaacacacaattaaattaatgttagaccatctctgcccttacagaactccttagcttcttggaggtagtaccatatcagtcaggagcagaaatcctagctgctttctttcgtatatatcataacatttaattgtattttatattatactattggttacaaatattttttatatatcaggatatacttcagacagcatt

SEQ ID NO: 2177 - DNA, 268 bp, Homo sapiens
tggaaccactgttttacaccacaggtttagggactgtttgtgagttaagggttcctttcggtgatctgtgaacttggtctttgcagtacctagatcctgccttggagattatttagtagtggggattatttagatggtatacttaaccatttttcagatgcctgaagactgaactttagaagcatttgttaattgattttataaaatatcttaggacttttttttcttaacctcatgaaaatacattaccatactgtgctgaaactaa

SEQ ID NO: 2178 - DNA, 296 bp, Homo sapiens
gcttacaacagtccattcatcaccacttcttgttcagctagttacatatctgtcttcagaccatgtttctgttctttatccatggagacacaaaagacttgactatgtgactccaataagttagaggtgtgaggcagcaagaatgattgggtgggacattgactctagagtcctacagacctgtaatataaacctgtctcctcctactctttactatgtgactatagcaaatagtttaacttctctggacttcagttttttcttctataaaatgaggagaatgatatctaccttgc

SEQ ID NO: 2179 - DNA, 260 bp, Homo sapiens
gggagccagacagtagacatgaagtcagttatgtcgtgtgcagaaaggtgctgtgtgctgtggaaaaaatagagcagtgtatggggattagggatgagggcggaaggatagttgcagtattaaagtggtgatcacgtaggctcatggggaaggcaggattggagctgagactaagagggagccattgtggttccctctgcttcagaggtagcccctggtttcatcttcgtccagcctctttttcggtgatctctctactc

SEQ ID NO: 2180 - DNA, 294 bp, Homo sapiens
gggtagcatcactggccccagtgtggaagttcaggcccctgacattgatgttcaggggcctgggagcaaactgaatgtgcccaagatgaaagtccccaagttctctgtatcaggtgcaaagggagaggaaactgcgattgatgtgacactgcctacaggtgaagtgactgttcctggggtctctggggatgtcagcctgcctgagattgctactggtgggctggaaggaaagatgaagggtactaaagtgaagactcctgaaatgattattcagaaacctaaaatctccatggg

SEQ ID NO: 2181 - DNA, 277 bp, Homo sapiens
gtgaatatgcttacatcccagagactacatatatggcaacaaagaaaacaaagtcctggccctcagggagcttctaatccagtaaccacaatttggtggtatgttcacggcatacaagaaacagtggaaggtctgtcaaggtttacaacaatgaaaatttccccctaaattcctagcaggtcgcaaagtgctcatacgcaattcaaaagcagcgacaacctggggtattaggctctctttctatgtcagcagggatgcccacatggcagatgcccaa

SEQ ID NO: 2182 - DNA, 286 bp, Homo sapiens
accagtttggaggactacgtgcacagatgaagccaaacctctggcccatcatctattccacccttcacgtccctcatgcccgggttccactggaacccagcggcctcacacatccttttggcttacaaatttcctagctggtgaccattctccaccacctccccccaagttttaccattctctattggtgccctacaacggctccacccttggaaataaggccgggtctaaatgttactttttctagtgggccttcctggattatccatcccacggtgattccttt

SEQ ID NO: 2183 - DNA, 273 bp, Homo sapiens
gagggacaggtgatcacacggtattggacacagggaaagggagcagccagaatttgtaagggagcagtctcgggcttggggaaatagcaagagagatcagggacagcccttagggttggggagcagccacagggacacagaatagccagagggagcaagaaacaagcccacgatttagggaatggccccgggaaggatctcccgttggaggtcagggtccaggcactcactgtgcattcctcacagccaacagtgtaggtcttggtgaagccc

SEQ ID NO: 2184 - DNA, 292 bp, Homo sapiens
tttgaggcccaccagctgattctgagaacctcctgcaccaccatggaaaagggattccctagccttctactaaccaaataccccagaagatacgatttcagctaaaaaagatagtggttccattaaccttaggagccaggaggcgagaccctgatccggggcgctctctgccacctaccgccagagccaacctccctgcctccctcggaacccccaacaccccagaacctcatgacccttgcagagccagcctgctgcctcctttgaagagaaccataagagaagcttcagg

SEQ ID NO: 2185 - DNA, 247 bp, Homo sapiens
gatctgagcttgtatttggtgcccaggacatgtgctgggttcccgaaatcccaaagacacagaccctaccctcagggatttctcattctagcaacatagactgatcaattactgattataacgttagaaggcatgtctgaagtagacagccatcaggacatggtgatttcaggctgggctttgaagaatgactaggagtttttcaagtgtcgaaactgaaccctgaccaacctttgcttttgcagac

SEQ ID NO: 2186 - DNA, 261 bp, Homo sapiens
gtcggaatggagtgccacagatgaaccacaagaggaagaaaaaaacacgtgagcaaacaaagcacagactaggagaaagctgtgttccatgtgaaccagatgaagaaaaccaaagatctatggagtttgatctctaagtggtttgaggttctgcagggtggattagccacaatgaagcttcaaaacagtggtaaccagaagtgacagagcttccccccactggtccccacccctcagtaaatttcgggatatccaatgacg

SEQ ID NO: 2187 - DNA, 284 bp, Homo sapiens
aagattgatgtcttagaaggacagggttaaaaccttctgtaatatatttaaatatatatttttaagagagatgctacattgccaatgattttataaataatttaaaattaatttacaaatttatagatgcaaaccaaaagatctttttaaaagagagagagaggaaaaaaatcaccttttatttgtttgggtctcattgtcagaattattattcagatcaagaaacctgtgtcgataaaacctaatctcatattggagagtgaatgtcgttaagtatttctgaa

SEQ ID NO: 2188 - DNA, 293 bp, Homo sapiens
caatgtgttatgttttcagatgacttacgtatgtttttgttcatcagtattttaaaaaataatcacctgtttgtgaaaataatggttttgaaaacagcattatgatgagagggaacttcgtaatttcatgagaatgtagatggtgactgtttaagtgggagctcacataggcattaacatcaccctccttttgcacagtccttttaagtctcctgttaaacatcttttattgtgtgtatttaaaggcacacagatgctttttcctgtattcatcttacaaatttacctacata

SEQ ID NO: 2189 - DNA, 289 bp, Homo sapiens
gggccattcaatagtgtatcttataagataaaaggtgaggtgtcaacatttggaattattttattcctaaatagcacatgaattattttgtgactacttaaagcagattaatagagttggtttgccgagaggcagggatgagctgttcttggtcaatatcaacactgaaggcagggcaatatttgtaccccctcctgaaaccaagtccttgagctcaaacattccagctttttgctcattactcatcatcctagaactggatttgtaagaatcatctctttaagagtgt

SEQ ID NO: 2190 - DNA, 271 bp, Homo sapiens
gaccttattatttctcagtttacataccaatactctcctatacatacacaatatactaagaggaatactgttgtcttcgtacccaaattacacataaacagataaaaactgacttttgccatccctttgcaaatgttgtagcaaattctaatgttctcaggccacgctggttcatgatccgagaatctgagacagttatagtcgaaatgtcataggaggcaggcgtggtggcttgccctgtaattcagcacttgggaggtcccttggacga

SEQ ID NO: 2191 - DNA, 284 bp, Homo sapiens
actagatctgtttttcctgacctgaacaccatacacctgttgagttcactaagtactttggggtttccaaaatgattgaggaggtgctaattaaagaatcaacatttaacgttttcaatgatccaccacctatttgatattaaccacatccttccacgggattgagttataactaatccagccttcaactggggcagtaagaagtgctgaaccagcaatacaaaaagctagagttctaatcttggtttggttgctaacttgctaggtgaccctcagtttctacc

SEQ ID NO: 2192 - DNA, 233 bp, Homo sapiens
tgtgagttgtacaccatgactggaatcgcttggacatactcttcagcagacatcgtgtgactgtggaagaaatgagtttcatgaagatgactgatagaaggaagccactgaaccagtcctctatctcctcttccaaggctaaagtttggagccacttgcagaaggctctcctcaaacccctgtgttctttgcctacccctgctgttgccacatcatcttggagagctggctgc

SEQ ID NO: 2193 - DNA, 294 bp, Homo sapiens
tgcagctccctttgccaaggcatttcctatagaatcctgccacccaaaaggtaccaaatatgagtttctattagctttcaacttctttaaacatatgctaatttgttcctctcccccgaaaaagagatttgcacgggtaaatagatagcaattatttcatttgtgcaggaaatacaagaattgagactactttctaaaactatccacaaacatggttattgtgctagcaaacttccagcgtaatttagagagaaagaatgagagaaaataaatgagcagttgcctggtactcac

SEQ ID NO: 2194 - DNA, 270 bp, Homo sapiens
acttggacctgaggatggccccaaactcccttggctcctctacaaaatcagggcacttttcagggaggacagcgtcccacgatggccacttatttatgtggtctgtcctttgcaacagtctccgcaacagccttccattgaattctgtctcattggacacctttctggggactggggacagggtaggcctgggcccgcaggttctcagcttgcagctgacagggcacggacaatgtgccaggcaggagcggaggcccttgccaactgatt

SEQ ID NO: 2195 - DNA, 264 bp, Homo sapiens
agggtaacctctctcatgattcattacctcccaccggctctctcccatgacatatggggattatgggaactacaattcaagataagatttggatgggaatacagccaaaccatatcaaagagtatattatgatccatgctgatatgaaggaaaattattctgccttggtatgagatggattgtgaaagagaaggacaagatttgctgatttattcaaaacatatttactgcatgcttacaatatactggccctcttctaatcaa

SEQ ID NO: 2196 - skipped

SEQ ID NO: 2197 - DNA, 285 bp, Homo sapiens
atggcagtgagcatttattccgggctgagttttacactacccatactgtctctaactctcccaacactcccacaaggcaggtgctattatccccattttacttttgagaaaattaaggcctaaagaagtgagaaagcttgtccaaaccgctatagctcttgggcaaaggcattagtgaccaatgtgtatttgactccaaagcccaggatgttagccacagtgcagggctactatccttttatacaatctgtcaggcttcttccatccgtggcatgtattcatcta

SEQ ID NO: 2198 - DNA, 276 bp, Homo sapiens
gggtttactaggctacaatctctactcctgaactggaaaatgttcacaataaataggtcaggaaaaaaaggaatgatttcactggttaatgtgtactcataggcactgcccacacaacggtgtgttttccactttcagtacagtcccacctttcttttcctctgctattttcttcagccagccacagggttaagagcattagctctggctttgaatcccagctgacctcaggaaaatttcttatctgtgactcagttctcccatctgagtgagctc

SEQ ID NO: 2199 - DNA, 255 bp, Homo sapiens
aattctaagcaatgatatgtggactaattcgatgatctacatggaggtttactgcctttgaaagaagcagtgatgactcgaagcctatgtggcctcattagtgaaaataatttcagaggaactttatctttgacaggatttacagctggatagattaggaaaaataattcaatggcataggatatttggccttttacagggcatttcatgacatacttgtgaaagatggagaaatataggccatgcaatgatatg

SEQ ID NO: 2200 - DNA, 197 bp, Homo sapiens
ctcttcttatttgaatacccttgacttcctctcttcctatttgaatactctttctttctcttgcctgattgctctggccagaacttccagtactgtgttgaataggggtggtgagagagagcatccttgtccttgtgccggttttcaaagggaatgctttctgcttttactcattcggtatgatactgtctatggat

SEQ ID NO: 2201 - DNA, 212 bp, Homo sapiens
acaatttgaccttctctcttcttatttgaatacccttgacttcctctcttcctatttgaatactctttctttctcttgcctgattgctctggccagaacttccagtactgtgttgaataggggtggtgagagagagcatccttgtccttgtgccggttttcaaagggaatgctttctgcttttactcattcggtatgatactgtctatggat

SEQ ID NO: 2202 - DNA, 236 bp, Homo sapiens
gtgagtaatgcggtggccccaaggtggtgctgaaatatccttcctcaacaaagaagataagcagcaaatgttttgagggtggccacaggggtcattactggtgggaattcaggaaagtcagcaaggggagctggcgagggtgtttccgtcccttctcaagagtccgtgtggctgtgtgaacagtgggacatcagggatttctccccaggcctacttttcaggattccctctaccta

SEQ ID NO: 2203 - DNA, 218 bp, Homo sapiens
ggcacagaggaaacccgctgagcctgcttccttagttctggcagatgggtcagcccccacaggactcaggattcaatttagcccggggttctggctccatctcccacagtgccggtgccagtgtgctcctaagtactgtttgtgcaaacctggctctgactgagacaaggagccttaggagtagtagggacaggagacacagcaaactagggctcaga

SEQ ID NO: 2204 - DNA, 285 bp, Homo sapiens
gattgcctaggaggacactgtcctcagtctttggggctagaaggttgaagagaagtaaactttgactgaattatccttctcatagagtttaacaggcacagtggaaattcctaggccgatttcactctcatataacactgttggcaggagaatgggtagcatgggagagtatcagcgataccagaatctgaccagaaggacaatgtacaagaaaaggtagggactttctgaaggcatttttggtggccgttggtggggattaggtatacagcacagattagactg

SEQ ID NO: 2205 - DNA, 269 bp, Homo sapiens
attctttgtcaggagagttttgtgaatttctgtttagtggcaagttgtagaaaccacttgaaactgcttaaaggcaaaagagggagccacttgtcccagtaactgagacatcccagagccgactgcccccaagcattacttggtcccaagtttcaaacgggtcttcagggtttgatctctctcctcatctccagtctgcttcattcattttggctctatgtggtggcagaagggcttctggcatctctggacctttatgcctcccaggt

SEQ ID NO: 2206 - DNA, 266 bp, Homo sapiens
aaggatttaaaccaacctgtgcaatgcgagtgtgttcagatacctggagccagcctttggaacctgctggatcaaaaccaacgtgtgctctgtggggcccctgaaacacgaatcctctgtggggttgattgagaaaggattcacaggcttcaagtcccagcaagatttatttgctagaattcaagcaaatctttacgaaagggagttctcatggatgaggccactgttgggggctgggccaggactagatggagccatggattcca

SEQ ID NO: 2207 - DNA, 271 bp, Homo sapiens
ttccctctggcaaggaaagactcagataaaattccccatgacttctaaaggtgctcctgggcattacttttcattgtttttcctggggatgctgtttcctcagaatgtcgttgtattatagtacattccttaagggatatggttttcattttcctgaatgttgctcctttctctcattttaccagcaacttgttactccctttcactttcagactcttttctctctttcccttctccttcagcaacttctctccccattgaagttagaagt

SEQ ID NO: 2208 - DNA, 288 bp, Homo sapiens
gctttagctgccaagtttctgttacttgtattttttaaaaacatgctactccgataggtatttctgttacttctaagtcacagaatgacactgataaatcatacatcaaaatagactattaaatctttaatgttcaaatacaatttttctagaaaagtaaaacgcagaaggctggaaggtgtgaccggcactccactctggccttgctccttaactgcaaagtcacacctgctgactgggcgcttaccctaccccgacaccaggaggatgccagtctacgcctcgaaa

SEQ ID NO: 2209 - DNA, 261 bp, Homo sapiens
atccctaataggctgggctttgcaggaaatggcatgaaatcagctcttctgagtgtacagaagaacctttcgagcattatttctacacccttctcccccactctttcctctttggaggcttccaagttagtgatgaatcccaacagctaatgatgctgggtttccagtttatttccttctgttagtttaatgtgcaagtcagtgaggttttgaatgctgtgcattgaatttgcttgctctcttctgtcttttagcaggttt

SEQ ID NO: 2210 - DNA, 272 bp, Homo sapiens
ggttaatatccatgctataaagttttattttttcatcaacaaaactaattgcattggcactttcaaaatgttgtttgcacataaatgatttatacttaagtatgagtgtaacaatcttgccatcaggacctggtctgttgggagatatcagtgaatggagcctggctcttccaatgggcaaccgttgtttgttggtgaagctgccacccttgagacctgcctggtctccttcccacctgtagctggctaagtagtgtctccccacaattcac

SEQ ID NO: 2211 - DNA, 182 bp, Homo sapiens
tcccttttctggattctcaagcagttactttcacggtcagaacacgcagctattatgattgaaaacttaaaagggcaacaatttcagtcttgcttctagggctagacaggaacttggcaaacatctgtggcctgttcagcaaaggatgttaatatttaagaatcttgtcttgggctgggtgt

SEQ ID NO: 2212 - DNA, 137 bp, Homo sapiens
tcagatatttccctttattccagatttcctggacactttcacccaattataaacaccccacttcagccccaatcacgtgggaggaagtgtaacttcccttttctggattctcaagcagttactttcacggtcagaac

SEQ ID NO: 2213 - DNA, 270 bp, Homo sapiens
atttccctttattccagatttcctggacactttcacccaattataaacaccccacttcagccccaatcacgtgggaggaagtgtaacttcccttttctggattctcaagcagttactttcacggtcagaacacgcagctattatgattgaaaacttaaaagggcaacaatttcagtcttgcttctagggctagacaggaacttggcaaacatctgtggcctgttcagcaaaggatgttaatatttaagaatcttgtcttgggctgggtgt

SEQ ID NO: 2214 - DNA, 264 bp, Homo sapiens
cttccaggctgttaggagtctcacaggctcatccgaaaaccaattcatgctcctgagcttcatgggttcgcctgccagtggaggcctagcctccatctcgcttaggatgcctgatgtgggctgatggcagaatcaggggagcgacacctgcttcccacaccacagagaagcctcttcgggctggggttggcagcagggactaacgacaatgccataaacagataaacagtgaatgcaccgagtcacagttttaacccgcattct

SEQ ID NO: 2215 - DNA, 251 bp, Homo sapiens
acacacacagatcccaacaagaatggacactgatgggtgaggacagctgctccctgaggagatggccactgggcactgttggcacatcattctgggaaatttcagtttagagcttattagaagagacccagacactaaaggtcaaaggcgggacatgaggagcacagggagagggatgtctattggcattcagagatctgttatactgtcaactaaaccgctctctgaatttgagcattatggtcatacat

SEQ ID NO: 2216 - DNA, 291 bp, Homo sapiens
gatcttcactttccgaacttcattggcctggaattcaggtagtacagtatgtggtggatgaagccaactaccgcctgtaagctacaggatagaaaagagactactactaagtgacaagaagcaggactgaatgcctttgggggaaaggcggatggagtccttgctccttttccccaaaccccatggggctcaccgccattgctatggccatcccaggcttctgttgactgtgtccattgggagaaggaaaaccagtggggtcttaagaagtgattttcttggtcagagcag

SEQ ID NO: 2217 - DNA, 275 bp, Homo sapiens
cttgctctaagaattgcctggactagcactaacagtgctgacctatggaagatcgtgtgagccacttaagcaactgcgaaagttctagtggccatattaaaaaagcaaaaagaaacaggtgaagttaattttcttattttacttggcctcatatagcaattatcatttcaatatgtaatcaatacattaaaaattatcagggagacattttatattctctgtttcatactaagacttccaaatctggtgtgcatgactatactctgcttgtcctg

SEQ ID NO: 2218 - DNA, 82 bp, Homo sapiens
ttcactttccatagtgggagtctcgggtttgaagtaaggagattaaacaaacggtcccaccctcagtaccactcatcgatcg

SEQ ID NO: 2219 - DNA, 286 bp, Homo sapiens
gagggcgagcacaattttacacaatttactggccaactgtgggcgaacagtgcgggggcataagcggggtgggattttttgtgggcgaatcttgggatgcgccagagatggggggacaatttgagtgtcggggaaaatctgtttccttttattaatttcatagagtattgccttggtcatttgtctatgagagattttcaataatagagtgcttggcgaacacacataatctggggggatggcgataaaggaaaatttaaaacatacttcattgcgggccgagact

SEQ ID NO: 2220 - DNA, 294 bp, Homo sapiens
tcaaggaaaactctacgtccaagtaaactcaagatatcaggaaataagattaaaaaggagtgtggggctgccactgacattttaaaatctcctctttgtattctctattttcagaaaacaatttcaacatcaagcatgaagtttatgatgaatataggaaatagaaaggatggtgaggattgaggatttgtctgtgggaaattattattgttctgatattttaaaacagaagagccaaaccaaaacaactgttcttttgactaaaaaggtgatgagagatttttagtgtcccca

SEQ ID NO: 2221 - skipped

SEQ ID NO: 2222 - DNA, 290 bp, Homo sapiens
gtgaaaccaaaagaacgcaggcaagaaacagaacaggagggggagggcgactaaaacatacactaccaggggaagaagaaaaagtggccgcagccccaggaggaaaataaagaaaaggaacccaccacctagaagacagacataataaaaaagaacacgccgagcatgcacgcgtcaaaaacaaaagaagaaggagaaaacaagcaccgcacgaggtgaagtcatttgtgaaggaaacgcacaacacaatatgtgcggggaggaaaaataagagcgataccaccctcacg

SEQ ID NO: 2223 - DNA, 211 bp, Homo sapiens
tcctttgggtcctgaagaacctacaggaccccgttctccttgagcacctttgggccaggtaaaccatcagagcctggaaaaccacgattggcaagagcaccctttcttccaatggccctggaagaacaactgttcctgaggtcactctgggaacccttttgccttctttagcgggtgggcctatcggacctggatacatgtggcctggttc

SEQ ID NO: 2224 - DNA, 280 bp, Homo sapiens
aatgagcaagcgtagttcactaaatataaaggagtttgttaaaaccagacagtaatagctataaaaggcacaacttcccttttctgatatacacttgtaaactttttttcaggtttccatgcataaatcaaaaatgctatcctaactatacaggggggggatacaccaacagaaagtctagaaaatttcatccagccaactgtgtaaaaaagtatgaagagaaagttcctcacacagactttgggcactggtggtttaggtggcatccatctttgactgt

SEQ ID NO: 2225 - DNA, 269 bp, Homo sapiens
gggcatttcttaattgctcctcagttctaagtgtccctcagaatgcctcagatatttgctttgactcagcagaagaagggaagatcgtggccagagatagcctgaaccctgcgagaggaggttagaaagcagaaagccctctgccagccaggtgggtaccaatggtcgttcctaggatgagacctcatgtaacagagcccaggcagtcctggggaactggacatagctggtgattggcaacaagttgatggcctgagacctttgacact

SEQ ID NO: 2226 - DNA, 208 bp, Homo sapiens
gggaggagactcagccgggcagccgagcactctagctctaggatgtaaacagagtaagagagccgcatgaattaactacgcgcgcctaccattttcttttgctccctctcaaaccctctccctttctctgctgctcctccgtagcagtactgtttgacaaaccgcatccttgtcctgtgagtataaatcatcgcaggcggaacagctg

SEQ ID NO: 2227 - DNA, 151 bp, Homo sapiens
gggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaata

SEQ ID NO: 2228 - DNA, 260 bp, Homo sapiens
tagatgtgaaaccttgggatgatgagacagatatggcgaaattagaggagtgcgtcagaagcattcaagcagacggcttagtctggggctcatctaaactagttccagtgggatacggaattaagaaacttcaaatacagtgtgtagttgaagatgataaagttggaacagatatgctggaggagcagatcactgcttttgaggactatgtgcagtccatggatgtggctgctttcaacaagatctaaaatccatcctgg

SEQ ID NO: 2229 - DNA, 287 bp, Homo sapiens
gctctcgaagtttatcaggatgttcacatgacaaaactggacccaggctactttagttttgttgggatattgtaagctaaatttttctgtaaccttagaaggccaagagactgaagccctccattttttcacagaacaggtagaacatggacagcagcaattcaacttttccccacactgccctgccaatgtgcctcgaccttgacctggggggcccacctctggggtgagagggtggctcattcattcagtccttggccattcttctgaaactgccaacaagggtg

SEQ ID NO: 2230 - DNA, 291 bp, Homo sapiens
gttgagttttttcagcgcctcgatgtccatgtgggggatatccacggccttagcctcgtcacagtgctgctggtcccccaggacacacacagagaacttagggcggggagtggacttaagcctgacggtgcccgagaagcgcttgtccttctggggatcatagttcttcaagctgatctgcaactccaccgtctccaggaacttgcggcgcttgcgctggttcccgtgcaggacttcccgcaccgcctcgtacagggtgtcgcgagagactttgctgctcatggcttctca

SEQ ID NO: 2231 - DNA, 248 bp, Homo sapiens
tgcagccttgcctcggaggccagcccacccccagaagccaggaagcccccgcgctggactggggcagcttccccagcagccacggctttgcgggccgggcagtcgacttcggggcccagggaccaacctgcatggactgtgaaacctcacccttctggagcacggggcctgggtgaccgccaatacttgaccaccccgtcgagccccatcgggccgctgcccccatgctcgcgctgggcagggaccgg

SEQ ID NO: 2232 - skipped

SEQ ID NO: 2233 - DNA, 176 bp, Homo sapiens
gtatctggacctcaaaattatgggaacatttacttaaacggatgatcatagctgaaaataatgatactgtcaatttgagatagcagacgtttcacacatcaagtaaaagatttgcatatcattatactaaatgcaaatgagtcgcttaacccttgaccaggtcaaagaaaagcttt

SEQ ID NO: 2234 - DNA, 103 bp, Homo sapiens
tggctctgtttctcagtactttgaagttataactaatctgcctgaagacttctcatgatggaaaatcagccaaggactaagcttccatagaaatacactttgt

SEQ ID NO: 2235 - DNA, 98 bp, Homo sapiens
catcaagaacagacaagggtgtgtagcggtttacaaatacagccataaaaaagtcaaacaggatctacatggcatcatcattccccttggccaatcct

SEQ ID NO: 2236 - DNA, 274 bp, Homo sapiens
aatcggacaccctgactgatgaataaatgccacaaaggacttgccaagtgggagaaaatatgaggttagaggataaagccagtactctcttgtttggtcataaacttgcctatctggtgataagattccaatgatgggaatccctttaaccttttgagggactccccaggcacttaactcatcctaaatagcaactgcatcaagaacagacaagggtgtgtagcggtttacaaatacagccataaaaaagtcaaacaggatctacatggcatca

SEQ ID NO: 2237 - DNA, 216 bp, Homo sapiens
atggtccattcacctttatgttatagatatgtctttgtgtaaatcatttgttttgagttttcaaagaatagcccattgttcattcttgtgctgtacaatgaccactgttattgttactttgacttttcagagcacacccttcctctggtttttgtatatttattgatggatcaataataatgaggaaagcatgatatgtatattgctgagttgaaa

SEQ ID NO: 2238 - DNA, 286 bp, Homo sapiens
taagagctccacaagtctgcttgtacgtagttatgtagatttacctgaatatttatcaattcatttgttttccattctttctcatgttatgtctcaggccttttataccagtttctttctgccacaaagacatccttagaatttagtttagtgatggtctggtgaagacaaattttctcattggttgtccaaaggaagattaattccaagtttgttcttgagaggtatttttgctggcatatgttcaatttgtcataatatttgtcaattgtaaactgttgtgcac

SEQ ID NO: 2239 - DNA, 265 bp, Homo sapiens
taatgttactgtgggctgtgggattaatttcaacgagaaggcgatccataaggagggctgtgtggagaagattgggggctggctgaggaaaaatgtgctggtggtagctgcagcagcccttggaattgcttttgtcgaggttttgggaattgtctttgcctgctgcctcgtgaagagtatcagaagtggctacgaggtgatgtaggggtctggtctcctcagcctcctcatctgggggagtggaatagtatcctccaggtttttc

SEQ ID NO: 2240 - DNA, 272 bp, Homo sapiens
ttgtgatagttcagtcccagggaaagagaaaactcgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgac

SEQ ID NO: 2241 - DNA, 258 bp, Homo sapiens
cgccctaggccctaggtgggaagatggtttgaaatttttgtaatcgagtaaggcacacccaaatgtaaaaatccttttgaatgatgcctttataaatctttctctcactgtctatttaagtgcaattaacatatgtcacgaacttgaaagttttctaaactcaataaggtaatgaccagttgttatttacagctctgtaacctcccgttgcgtcaagtctaaaccaagattatgtgacttgcaataaagttattcaga

SEQ ID NO: 2242 - DNA, 299 bp, Homo sapiens
cgcttcacagctcgcgatgactttgcctactgcctgaactgcttctgtgacttgtatgccaagaagtgtgctgggtgcaccaaccccatcagcggacttggtggcacaaaatacatctcctttgaggaacggcagtgggcataacgactgctttaactgtaagaagtgctccctctcactggtggggcgtggcttcctcacagagagggacgacatccttgtgccccgactgtgggaaagacatctgaatcaacacagagaagttgctgcttgtgatctcccacacgaatttttatgtt

SEQ ID NO: 2243 - DNA, 161 bp, Homo sapiens
tcagcggacttggtggcacaaaatacatctcctttgaggaacggcagtgggcataacgactgctttaactgtaagaagtgctccctctcactggtggggcgtggcttcctcacagagagggacgacatccttgtgccccgactgtgggaaagacatctgaa

SEQ ID NO: 2244 - DNA, 286 bp, Homo sapiens
tcaatctgaacgttcctttctccgtccccacccagggactggaagaattctgtgggctccaggcccgggcatccgctggaaacaggggtgggtagggtcgtgtcatctaaaggcgcagcttcaaccagaagactagaagtcagccaggagctgggagtagtgtcacgcggggtgggggttcctatgagcatcactttacaaaaccaggagggacggaagtgcgagggggcagagtcttggaaacaggtcctgggccaactgcaacagaatatacccgccgcgtgta

SEQ ID NO: 2245 - DNA, 99 bp, Homo sapiens
gaggcgttgtcaatatgtaccacatgaaggaagatggttgggtgaaagtaaaagtacagatgtcagtgacctgctgcacccgtaccgggaaccaatcaa

SEQ ID NO: 2246 - DNA, 150 bp, Homo sapiens
tctccacgggtagtgggaacacttatgcctacggggtcatggacagtggctatcggcctaatcttagccctgaagaggcctatgaccttggccgcagggctattgcttatgccactcacagagacagctattctggaggcgttgtcaata

SEQ ID NO: 2247 - DNA, 273 bp, Homo sapiens
ttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataagtaatcctcgtgc

SEQ ID NO: 2248 - DNA, 251 bp, Homo sapiens
gaatatggaggcaccaaagtagttctagatgacaaggtgtgtaaacttaataattctaaaaagaagtcagatatttgcaattagttgtcttaactaatggtttttttcacttgcaggattatttcctatttagagatggtgacattcttggaaagtacgtagactgaaataagtcactattgaaatggcatcaacatgatgctgcccattccactgaagttctgaaatctttcgtcatgtaaataatttcc

SEQ ID NO: 2249 - DNA, 242 bp, Homo sapiens
ttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaataaa

SEQ ID NO: 2250 - DNA, 240 bp, Homo sapiens
ttctagatgacaaggattatttcctatttagagatggtgacattcttggaaagtacgtagactgaaataagtcactattgaaatggcatcaacatgatgctgcccattccactgaagttctgaaatctttcgtcatgtaaataatttccatatttctcttttataataaactaatgataactaatgacatccagtgtctccaaaattgtttccttgtactgatataaacacttccaaata

SEQ ID NO: 2251 - DNA, 249 bp, Homo sapiens
tagtcgtctttatccttggcgccatgtttgaggatgcgggtgaactccacgtatttgaagttgcctttcttatcatgggtgcctcccggtacatctcgtccacttcctcatctgtgaagcggtcacccatggtggtgagcagctcccggaggtggtcctcatgggatgaaacctgaggctttcctcgtcgaagcaggcaagggcgttgcgaatcacatcctcgggggtgcgtgccgttcagcttcttcc

SEQ ID NO: 2252 - DNA, 34 bp, Homo sapiens
cccagggccaggcgcgctgccacgtgcccctgca

SEQ ID NO: 2253 - DNA, 218 bp, Homo sapiens
tttttgatcacagccattggctgcacaaacaaacggcttttctcctgtgtgcttgcacaggtgcgcgtcaagcttccaggctttgctgtaattggcgctgcagtcagggaaggagcagatgaacctcctgggaagcgcggggcgcggcggggtcggagctgagctctcgccggctgcaatgaacgcgtcggcgatggtcaaggacgacaccgactcgg

SEQ ID NO: 2254 - DNA, 83 bp, Homo sapiens
caagagaaagctgtggaagacctatacaactgtggtttatctccaaagccatatccctcttcttccatgaggaaaggccgccc

SEQ ID NO: 2255 - DNA, 157 bp, Homo sapiens
tggcaaaaacatggacggaacttctgaaacatgtgagagaaacccataaagaggaaatactatgtgaagtatgccggaaaacattttaaacgcaaagattaccttaagcaacacatgaaaactcatgccccagaaagggatgtatgtcgctgtccaa

SEQ ID NO: 2256 - DNA, 209 bp, Homo sapiens
ttggggagacttggggccagcgcttctggtctggtaaatatgtatgatgtgttgtgcttttttaaccaaggaggggccagtggattcccacagcacaaccggtcccttccatgccctgggatgcctcaccacacccaggtctcttcctttgctctgaggtctcttcaaggcctccccaatccaggccaaagccccatgtgccttgtcca

SEQ ID NO: 2257 - DNA, 150 bp, Homo sapiens
tcagagcaaaggaagagacctgggtgtggtgaggcatcccagggcatggaagggaccggttgtgctgtgggaatccactggcccctccttggttaaaaaagcacaacacatcatacatatttaccagacccgaagcgctggccccaagtc

SEQ ID NO: 2258 - DNA, 157 bp, Homo sapiens
aggccttgaagggacctcagagcaaaggaagagacctgggtgtggtgaggcatcccagggcatggaagggaccggttgtgctgtgggaatccactggcccctccttggttaaaaaagcacaacacatcatacatatttaccagacccgaagcgctgg

SEQ ID NO: 2259 - DNA, 264 bp, Homo sapiens
gcaggattgaaaatgtccaggaaagtggccaagaagcagtggccttattgcatcccaaaccacgcctcttgaccggctgcctctcttgtggcagcaacggcacagctaattctactcacagtgcttttaagtgaaaatggtcgagaaagaggcaccaggaagccgtcctggcgcctggcagtccgtgggacgggatgggttctggctgtttgagattctcaaaggagcgagcatgtcgtggacacacacagactatttttagat

SEQ ID NO: 2260 - DNA, 284 bp, Homo sapiens
acaaccatgtcatttcagaagttagtttgtatatattataataatcttataattgttctcagaatcccttaacagttgtatttaacagaaattgtatattgtaatttaaaataattatataactgtatttgaaataagaattcagacatctgaggttttatttcatttttcaatagcacatatggaattttgcaaagatttaatctgccaaggggccgactaagagacgttgtaaagtatgtattattcacatttaatagacttacagggataacgcctgttgg

SEQ ID NO: 2261 - DNA, 198 bp, Homo sapiens
gcactggcgaggagagggcgctcctctctgcacacctactagtcaccagagactttagggggtgggattccactcttgtgtttctattttttgaaaaacagacattttaaaaaatggtcacgtttggtgcttctcagatttctgaggaaattgctttgtattgtatattacatgatcaccgactgaaaatattgtttt

SEQ ID NO: 2262 - DNA, 105 bp, Homo sapiens
tcccatagttctcccgcgtctggttggccccgtgtgttccttttcctatacctccccaggcagcctggggaacgtggttggctcagggtttgacagagaaaagac

SEQ ID NO: 2263 - DNA, 224 bp, Homo sapiens
gttcctgcattagcctcagggatttagagatactgttgttacttctgcatgttcattgcaaacagaaggttccttgagcacccggaaacggtcacgagacccagaggaagaattataacccagaaacaatctcaagtgtacaaatttattgatgttgtgaaatctatgtgtacagtggacttgttaccttaaagtataaataaacacatctatggccatgaatg

SEQ ID NO: 2264 - DNA, 123 bp, Homo sapiens
caggccttgcttgttcctgcattagcctcagggatttagagatactgttgttacttctgcatgttcattgcaaacagaaggttccttgagcacccggaaacggtcacgagacccagaggaaga

SEQ ID NO: 2265 - DNA, 281 bp, Homo sapiens
  misc_feature (49)..(91): n is a, c, g, or t
  misc_feature (117)..(117): n is a, c, g, or t
  misc_feature (234)..(234): n is a, c, g, or t
ctcttaattttaagtgtgtatgtgcattaaacaaaaattagcttactannnnnnnnnnnnnnnnnnnnnnnnnnnnnnnnnnnnnnnnnnnactccacgaaaccacaatcccaaccnaatcacaaaaacaaattttgggccccttcggcccctcagaaaactttctaaaaccctttcgtttgggggcggggcgcccccataaggtataatgggaccctgggccctaagcgtggnttccctaggaaaaaaccctgggccacctgaaccaaatgggcgctggg

SEQ ID NO: 2266 - DNA, 280 bp, Homo sapiens
ccgtgaattggatgccatttccactaatgaagaggaaaaagaggagaatgaagctgaatctgatgtcaaacatagaaccagagattataagaagaccagtctagcaccttatgtgaaagtttttgaacattttcttgaaaatctggataaatcccgaaaaggagaacttcttaagaagagtgatttacaaaaagatttctgaagacagagctcctcaaaccattgtggatatcttctgccttcaaccacagatcaaatacttcaagagccatttaataaa

SEQ ID NO: 2267 - DNA, 195 bp, Homo sapiens
gccattgcaactggccgtattaagtcctttgtatcctcactgttccatactagctcagcctatgatgtggacttcagcaaatgtgtaagcaaatctttgtgcatgatgtgtgttaaatagaagcattaggcaaaaaagaatgtaaaagtaaatgggctttgttttgtttcctttgctgttcttccatatattatc

SEQ ID NO: 2268 - DNA, 290 bp, Homo sapiens
gttctccaaaaacgcccagtgatagtgaaggtactgagtacaacaaagccatttgaatatgagaccccagaaatggagaaaaaaataatgtttcatgctacagtggctacacagacacagttcttccatgtgaaggttttaaacaccagcttgaaggagaaattcaatggaaagaaaatcatcatcatatcagattatttggaatatgatagtctcctagaggtcaatgaagaatctactgcatctgaagctggtcctaaccaaaaatttgaggatggtccggcacagcg

SEQ ID NO: 2269 - DNA, 192 bp, Homo sapiens
tgaggcaaagcccaacacacctgtcttttgtccacttctccagcaaattagatttgtctctgggaatgtgtttgtaacataccaacctactgcagaccagcagagggagctcccatgttgaatttgtttgttagctattttcccccctttcacaaaaactatttcttgacgacctttgagagatttcaataa

SEQ ID NO: 2270 - DNA, 142 bp, Homo sapiens
aggctacttctcagggctggaagtcccgtcagttctgctgaatactatgtcccaggtgtgtgatggcggctgcaatctgtcttgtgggtattaatgcaatcttcagtggtggctactgttctctagcttgttctacaaaact

SEQ ID NO: 2271 - DNA, 281 bp, Homo sapiens
  misc_feature (102)..(123): n is a, c, g, or t
  misc_feature (172)..(172): n is a, c, g, or t
aaaaattcttgtccccgccgctatgtggaacacccactccccacaacacctagtgtactgctcaacaaacacttgattttcgcccatgcgggcaactcttannnnnnnnnnnnnnnnnnnnnnggcgagataaatatactttcccgccgcgggaggaaaaacacgcgccggngaaaaaaattaatttctttaattattcgccaccccatttataacacacaagagcgggggggaccacacccccccgccgggtgttgtgggcgcacacaaaagaatatatt

SEQ ID NO: 2272 - DNA, 201 bp, Homo sapiens
cacgcctaccgcaagctcttggagggcgaggaggagaggctacgcctgtcccccagccctacctcgcagcgcagccgtggccgtgcttcctctcactcatcccagacacagggtggggggcagcgtcaccaaaaagcgcaaactggagtccactgagagccgcagcagcttctcacagcacgcacgcactagcgggcgcgt

SEQ ID NO: 2273 - DNA, 120 bp, Homo sapiens
  misc_feature (70)..(70): n is a, c, g, or t
  misc_feature (84)..(84): n is a, c, g, or t
atgaacatttagggactgtggtttttataaagaattcggggagaaaaatttataaggccacgacccgggnttaacagaaaaggnaaaaaactggttggcgccttcgggcctcaagaggtt

SEQ ID NO: 2274 - DNA, 182 bp, Homo sapiens
  misc_feature (59)..(59): n is a, c, g, or t
  misc_feature (132)..(132): n is a, c, g, or t
  misc_feature (146)..(146): n is a, c, g, or t
gggaccatttctctgtcttttttgatcagggcctatacatcgaaggtgtgcatatatgntgaatgaacatttagggactgtggtttttataaagaattcggggagaaaaatttataaggccacgacccgggnttaacagaaaaggnaaaaaactggttggcgccttcgggcctcaagaggtt

SEQ ID NO: 2275 - DNA, 259 bp, Homo sapiens
tccttcccataagatgcttcttcattgccacttgtagaacacgggggtcaacccatcataaaatctattatggaatgcctgagacaagaatcaaacagtccctttagtaagtttgtttattcacttctctattgattcattcaagaagtctcatgccagccccacctattggaagaaggtctgagttttattcttatctctttggtattaattctgaaacttagaaagtacactggttagcaatgcttgggaccaacag

SEQ ID NO: 2276 - DNA, 165 bp, Homo sapiens
cattcccaagggagcttgcacggtactgaccgagtgctgagactactggtattcccagctgccatgtggcagcagcaggagctactagaatattctcagcacaggaatgaggcttccttggtttccatgtctgtaagggttactgatcacttaccttcttctctt

SEQ ID NO: 2277 - DNA, 104 bp, Homo sapiens
tccggtccagtcacaatcatcatgtcactgtggggacccagatctgtgtcttgaagcagctgccctcattccgacttcagaaaatcgaagcagctggctcctcc

SEQ ID NO: 2278 - DNA, 251 bp, Homo sapiens
ccttcacagcttctattggacatattttctttttaggaatgaaggaaaattctcccatttttgagccattcttttgtcaattctacaaaattgcatgtaactttataaatatttttaaaagatatagttttgtaaatatttaatattccgctaatttgattttgaattgtaaatgtcaagtattctgtttttggggtttttatgttttattatactttgttaaaaaggacaaattgtacatttttagaatg

SEQ ID NO: 2279 - DNA, 294 bp, Homo sapiens
tctgctggtcggttctgctatgggactgtgttctggggacagggcttaggtggtgatagcgctggcaggaaaccagaggcctcttggtccccacatgggaggactacttttcctggctctgccccctgggcaccttttaagttttctaggcgttagcttagaaaggatggtgtagttaggacaggagattgggtgtgtccagagtagacgttcaccacctgagacctgggtgggactagaatcatgggtttggatggcgcttgttctttcttctggttgagtcaggccttaaca

SEQ ID NO: 2280 - DNA, 263 bp, Homo sapiens
  misc_feature (158)..(176): n is a, c, g, or t
ggctttggacgagggcagaaccacaacgtgcaagggttccacccctaccgacgctagcccgcggcgccgcgaagtcttgcacggcccagacccaggattccaaacttgtgaactcgtgacaatcacaaacttggcggcaaagtggcgactcaaccttnnnnnnnnnnnnnnnnnnnagggcgcgaggcttttggagcggctgtgggtgtcgtctggactgaggtttttaaatatttctttctctaacccatcagcacaataaa

SEQ ID NO: 2281 - DNA, 145 bp, Homo sapiens
aaatctactgagtgtatttctgttttttgtttaattccttgcttttgtcgactgacctgcttggtagtgtctgaggtgaactgtgggggttgcgcacagccagccgcgtggatcccacgcagcgctgaaccgaaccgagtaggaa

SEQ ID NO: 2282 - DNA, 246 bp, Homo sapiens
cagctgcctccaggatgagttacttgaaatttgccttgagtgtgttacctcctttccaagctcctcgtgataatgcagacttcctggagtacaaacacaggatttgtaattccttactgtaacggagtttagagccagggctgatgctttggtgtggccagcactctgaaactgagaaatgttcagaatgtacggaaagatgatcagctattttcaacataactgaaggcatatgctggcccataa

SEQ ID NO: 2283 - DNA, 268 bp, Homo sapiens
ggtttccatccacgatgtcatgggaccccatgttctcaagatggactctctgctccttcaggaactgaagggccttgtccacattctctaagcagtggatgcgcattcgtcccttggtgggtttaggcagcctctctccagagaggacctccagcagcttgatgagcatccgtccatctcgaaggtcagtgtacaggtctgtgatccggcaggacacacgggcaaggtgggaattgacccacttggtgaaggtcttcttctgcacggc

SEQ ID NO: 2284 - DNA, 80 bp, Homo sapiens
atgggagctcatctccttccatctctcctaatcaagagcaaagggaacagcaggcctaacagcagggttgggaaggcaaa

SEQ ID NO: 2285 - DNA, 290 bp, Homo sapiens
caatagtcaatctttggtttttctttttggtacaaaaataccagtgcttgttatactagttactaaaagaagaagaaactcaaaattcctatctgcgtgctaatttgaaaagaacaacgtagatagatttgttggcacatatatatggcatattcacatatggcatatatacatatggggagaaaacatgaaccaaaggccaattcagttatgggagctcatctccttccatctctcctaatcaagagcaaagggaacagcaggcctaacagcagggttgggaaggcaaa

SEQ ID NO: 2286 - DNA, 279 bp, Homo sapiens
ctttattcacaatcttaggtctcaaatattctgtcaaaccctaacaaagaagccccgacatctcaggttggattccctggttctctctaaagagggcctgcccttgtgccccagaggtgctgctgggcacagccaagagttgggaagggccgccccacagtacgcagtcctcaccacccagcccagggtgctcacactcaccactcctgtggctgaggaaggatagctggctcatcctcggaaaacagacccacatctctattcttgccctgaaatacg

SEQ ID NO: 2287 - DNA, 222 bp, Homo sapiens
cctcgcctaattttcaccacaaagattttcttccaccccgttctctcctcttcctgtcggttttacggcctctcacggcgtggccatgccgctcactatcacggacacccataagcccctcacatatattcttccccccaaaacactcactgagagttttgttcccccctatatcagacccccatatatcgcggttctgccgccgcctttattgcacgctgg

SEQ ID NO: 2288 - DNA, 204 bp, Homo sapiens
tgacccaggacccaacatggtctagggatgcaggatccccgccctggggtctggtcctcgcccatcctgcagggattgcccaccgtcttccagacaccccacctgaggggggcaccaggtttagtgctgctgctttcactgctgcacccgcgccctcggccggccccccgagcagcctttgtactctgcttgcggagggctggg

SEQ ID NO: 2289 - DNA, 275 bp, Homo sapiens
tggccaggtgtcacaggtgtccacaggtgtggactgagggcttgtagccaccgacgctgcctcggtatggatctcttggcagagggggctacaggtgtgactgcaggtgtggccggcgcgcacacatgaagtcacaggtgttgaaccagtgtccaggcctggcgggaaggcgcaggccggatcactgggtgccagagccgccgggacgggaagtttcgtctcgcggggaagtcaggagggccggcgctttcactcgtgccgaattaaacacccgg

SEQ ID NO: 2290 - DNA, 38 bp, Homo sapiens
ctgccgcggccgcccagtctaataaaaagaactccaga

SEQ ID NO: 2291 - DNA, 193 bp, Homo sapiens
agaagagcctggtcctggtgaagctggaaccctggctgtgccgagtgcacctagagggcacgcagcgtgagggtgtgtcttccctggatagcagcagcctcagcctctgcctgtccagcgccaacagcctctatgacgacatcgagtgcttccttatggagctggagcagcccgcctagaacccagtctaatg

SEQ ID NO: 2292 - DNA, 252 bp, Homo sapiens
acagcgcccgcaagttgaggtcatcgtcccgagggtcgtggcgcccgtccgtgatgactaccgcaaacacacgtgtcttctggcgccggctctccttgatgaggcggtcgtaggcaaacttgagggctgagggtgtccaggtgccacctgcaatccactcgaggttctcgacagcctccattgaagctcgacagggagtcgatatgttcgtcgtccagctggatgcactcaaaggtgccctcgtgctgtact

SEQ ID NO: 2293 - DNA, 43 bp, Homo sapiens
tcagttcaactgagcgacgtgtatactcctgggcgtgaaacag

SEQ ID NO: 2294 - DNA, 259 bp, Homo sapiens
aagattatggcgacactcttgccgccatccagggcttactgaagaaacatgaagcttttgagacagacttcaccgtccacaaggatcgcgtgaatgatgtctgcaccaatggacaagacctcattaagaagaacaatcaccatgaggagaacatctcttcaaagatgaagggcctgaacgggaaagtgtcagacctggagaaagctgcagcccagagaaaggcgaagctggatgagaactcggccttccttcagttcaa

SEQ ID NO: 2295 - DNA, 234 bp, Homo sapiens
gaggagaacgacaaactgcgccaggagtttgcccagcacgccaacgccttccaccagtggatccaagagaccaggacatacctcctcgatgggtcctgtatggtggaagagtcggggaccctcgaatcccagcttgaagctaccaacgcaagcaccaggaaatccgagccatgagaagtcagctcaaaaagatcgaggacctgggccgccatggaggagccctcatcctggaca

SEQ ID NO: 2296 - DNA, 285 bp, Homo sapiens
gagaatccagttctttggctgtgctgttgctttgggaagttgtgtcagataatttcacttctacttgagccatcatttctgtaacatctttaatcagtttctctgcttcctcaaagagattccctatgtttttcagtggctctgctgcggggctctgcgccaggatgtcttttatctcgctgactttcctctccaccgagtccacagtctcacggtaaggcccgatcacaccactgatcttcaggccttgctttctccaggaatctgtgtgtcctgttggcagca

SEQ ID NO: 2297 - DNA, 193 bp, Homo sapiens
aatctcattggattactcctccttacattactgcgtttggatttgtagtcttaacaaggcaataaatggaaggggaaagaaggaatcaattcatggtaactagaatgtaatgagcacttgcattaagtcacaatttaatttgtatactttcggaaattctttcctggttgtaagcctaaaggggcctgcctag

SEQ ID NO: 2298 - DNA, 285 bp, Homo sapiens
atttcctcaatctaagcctctggttttaagacacctttgacactggttgttgtttctgcacgtgttttcagagcgggctaacaccactgcatgtagctgcacattacgataatcagaaagtggcccttctgcttttggaccaaggagcctcacctcacgcagccgcaaaggtacctataattccacagcctaaggagactgatgggtaaggtctatcagtctctatctgcacatctacttctgcttcagcaggagcaccctcctagtttagccacgacatgccgg

SEQ ID NO: 2299 - DNA, 240 bp, Homo sapiens
gccagtgttgtttaggcagtgtaacatttaccggctgtgtacagcaaacaagctattttttagaaaccgacgtttcagggaagaggggagagagccgcggggtcctgcccgtggttactatgaatgtattgctgttggaggacatctcgatccaaagaacagccgttcctgtgcggcccttcgttgccctaaagctttcattttttaaagaaataaagagtgcttgagggccttggaact

SEQ ID NO: 2300 - DNA, 267 bp, Homo sapiens
tgggctggcgcctagtaggattcttgctctgagccaatacattactgccactcggggttattcacggaccacgttataaccacacttcctcttagtccgcacgaatgccagtgatttttcacctccgcataactgtaatcctgttgatcttcctgtgccttgagggtcttctgtttttcactttcactgcagttatgtttggcacccaaatccactccatatgcaacgacgagacggtaagctttgttctcggctgtgtggacttca

SEQ ID NO: 2301 - DNA, 288 bp, Homo sapiens
gggaaccgagtctgtgcaaagcctcctgcttgtgagtgtggggtaggcacatgggggagggtcagcctggctgggagtcctcagcagtttgctcctctttgctgacaagcgcacttgccccttcctcctctgcgctcagactctacagctactcagcagtccagcttctgctcccaccccgctcctgctcctgcggaaaaggccccagaagcctggagagctggaggcggccaggaagtcagggtagaaggtgtgtgcagggcgtgctcctgcctggtgacagaagtc

SEQ ID NO: 2302 - DNA, 73 bp, Homo sapiens
ggcctgtctgcaagcattaatgcaggagtgtttttcacggagctaacagaaaacatcttccactgtgtaagtc

SEQ ID NO: 2303 - DNA, 234 bp, Homo sapiens
actccatttgcctttgttattgaccttgctgcacttgcttcacgtcgtgaatacctcaaacttgataagtggctcacagataaaattcgagagcatggggagccttttatccaggcgtgtatgacttttttaaagagacggtgtccttctattttgggcggacctgccccagaaaaagaccagcccaaaagtgctcaacttcctccagaaactttggcgacaatgttggcctgt

SEQ ID NO: 2304 - DNA, 297 bp, Homo sapiens
catgtttcttcctttctcgttaggaagagcttggatttgattgaatctctgctgaggcttgcagaggttgggcagtatgagcaagtcaaacagctcttcagcttccctatcaaacactgtccagacatgctggtattggccttactacaaattaacacctctctggcataccttgcgccatgaacttatctccactctgatgccaattttccttggaaccatcctaactcagctattattttgcactatgcatggcatgggcacgtaagatgtgacacgtggcatctctcaatacgg

SEQ ID NO: 2305 - DNA, 228 bp, Homo sapiens
gcttggatttgattgaatctctgctgaggcttgcagaggttgggcagtatgagcaagtcaaacagctcttcagcttccctatcaaacactgtccagacatgctggtattggccttactacaaattaacacctctctggcataccttgcgccatgaacttatctccactctgatgccaattttccttggaaccatcctaactcagctattattttgcactatgcatggc

SEQ ID NO: 2306 - DNA, 187 bp, Homo sapiens
tggcaggagcctgatgccggtcaacttgaaatatgactagcaacaagtcaggattgctggtgttatattctctaaagcctggggtcttcatcacatgagcagattcccagccagtgttttgacaagtgctcctttgcaatcgattgtttgaacctatatgtctgattttacatctaccttctgagaa

SEQ ID NO: 2307 - DNA, 239 bp, Homo sapiens
gcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgccctggacagatgttctctactcccgcaatccagctatgatgtacccacaaccagacatccgaagcgtaacatcaaccaccag

SEQ ID NO: 2308 - DNA, 269 bp, Homo sapiens
agctgtcctacatcagcttccagaacccccgcacagtccctgttcagcctgccttctccacggtgccgttctcccagcctgtctgtttcccacccaggcccagggggcgcagacaaaaacctcccggcgtgtggcctgccaacccggctcccattacccagacagtcatccacacagtgcagagcgccctggacagatgttctctactcccgcaatccagctatgatgtacccacaaccagacatccgaagcgtaacatcaaccaccag

SEQ ID NO: 2309 - DNA, 292 bp, Homo sapiens
aagtccatcctcctgtcaggcactgtcctgcccagtgctcagaggttccacatcaacctgtgctctgggaaccacatcgccttcccactgaacccccgttttgatgagaatgctgtggtccgcaacacccagatcgacaactacctgggggtctgagggagcgaagtctgcccccaaaaatgccccttcgtccgtgggccagagcttctcagtgtggatcttgtgtgaagctcagtgcctgacaggaggatggacttggatgggtacagcccccccagaatggtggtgataa

SEQ ID NO: 2310 - skipped

SEQ ID NO: 2311 - DNA, 83 bp, Homo sapiens
tccacagattatcaagtccttctcctgcaacaaatgcccaagtcattttttaaaaatttctaatgaaagaagtttgtgttctg

SEQ ID NO: 2312 - DNA, 241 bp, Homo sapiens
acaacaagaccatttgtgacagcagcgtgtccacgcatgacctgaaggtgaaatacttggctaccttggaaactttgacaaaacattacggtgctgaaatatttgagacttccatgttactgatttcatcagaaaatgagatgaattggtttcattcgaatgacggtggaaacgttctctactacgaatgatggtgactgggaatcttggaatccagtggaggcataaaccaaatgttgtt

SEQ ID NO: 2313 - DNA, 257 bp, Homo sapiens
  misc_feature (165)..(165): n is a, c, g, or t
  misc_feature (184)..(184): n is a, c, g, or t
  misc_feature (223)..(223): n is a, c, g, or t
tttcatgtttccaatgtacctgatttttcatgagccttacagacacacagagacacatacacattgatcttaaaatttttctcagtcactgatatgcaaaggaccacactgtctctgcttccaggagtatttttagaaatgttccacaatttactgaagacatanagatgatgctgctgcttangtgccttttagcaagctatgcaaacaatcctgataaaancagatacttagagagtcaatctggcttctgagaa

SEQ ID NO: 2314 - DNA, 119 bp, Homo sapiens
ttctttggccttaatgggagcccatcaacttcaactgctcgtggcttctttgcccacatgcttttcccctgaaaaaaaatggagggccggccctgacctggcctcacaatgaaactaaa

SEQ ID NO: 2315 - DNA, 252 bp, Homo sapiens
tgcagtcacagctacacagatcacagcttcagccaggagctgggcagaaagccaagaggctgttcccaccaggctgctcagggctggtcttttaggaccctttccttggaccccctatggtgggggcaaaactttctttggccttaatgggagcccatcaacttcaactgctcgtggcttctttgcccacatgcttttcccctgaaaaaaaatggagggccggccctgacctggcctcacaatgaaactaaa

SEQ ID NO: 2316 - DNA, 237 bp, Homo sapiens
ttgtgggaatcgttggatacacttccaaagaaaccccttttctctcaaatccagggacaaatttaktgtttgaagatgaaatcactgcattacaacctgaagtagataagttaaaaactctaaatgtgaacaaaattattgcactgggacattcgggttttgaaatggataaactcatcgctcagaaagtgaggggtgtggacgtcgtggtgggaggacactccaacacatttcttt

SEQ ID NO: 2317 - DNA, 112 bp, Homo sapiens
gagcttttccatttggtgctccaatgtctcctgctggacccatctgcctagtggaaggcagcaaaatttcaagaaacaggtgaggttgagcagcttggtgcaaccccatggg

SEQ ID NO: 2318 - DNA, 252 bp, Homo sapiens
agagaagactgtcggcgctctgccatagcaccgcaaccgtgtgagcagcaggctcatcccgtggaccggtggtgggaacgtgaggaagaggggaaggaaggaagagcttttccatttggtgctccaatgtctcctgctggacccatctgcctagtggaaggcagcaaaatttcaagaaacaggtgaggttgagcagcttggtgcaaccccatggggccctggagttggagctcaacagcaatggatttcaga

SEQ ID NO: 2319 - DNA, 257 bp, Homo sapiens
ccatctaccccaacaaaagacaaagaaattgttgtcctccactcagctttttttttttttttcctgtttgggggaaggtggtctagaaactgcacgtgatagtaagtaaagcaattagggcccaattctccccacagcctggatcatcttttaaatacccaccccaagccaacgggaaaaaaggcctccctttaaaaaggggaaaacaaaggcccttacttaccccaaggacagaggccgttatcggtgagaaactt

SEQ ID NO: 2320 - DNA, 288 bp, Homo sapiens
agcgagctgaggcacttgtccgttcgtcttaccatctaccccaacaaaagacaaagaaattgttgtcctccactcagctttttttttttttttcctgtttgggggaaggtggtctagaaactgcacgtgatagtaagtaaagcaattagggcccaattctccccacagcctggatcatcttttaaatacccaccccaagccaacgggaaaaaaggcctccctttaaaaaggggaaaacaaaggcccttacttaccccaaggacagaggccgttatcggtgagaaactt

SEQ ID NO: 2321 - DNA, 39 bp, Homo sapiens
tgagccctgcttgggttgttccacacacagttggcctgt

SEQ ID NO: 2322 - DNA, 100 bp, Homo sapiens
gcactcatgagtgactgctggatctacaagtgggaggatcgccccgacttcctgaccgtggagcagcgcatgcgagcctgttactacagcctggccagca

SEQ ID NO: 2323 - DNA, 99 bp, Homo sapiens
ttatcacagagccaagtgactgaacacgcattcccaactatatatctacagatgcattccattttaactcttcttgagctaaaacgtcaaataggagag

SEQ ID NO: 2324 - DNA, 148 bp, Homo sapiens
gaggagtaggtattctctgaattaaccatagatttgctcacagagctgaatgtgaagctgtgttcatacttgtttctgtggcaggtttttgtctctgctcaatttccttatttatatctattttttgacccaggcaaacttcagctag

SEQ ID NO: 2325 - DNA, 115 bp, Homo sapiens
agctttccagaaaacctccttctgacttaaaactcttttaggttggacagaaattcctgtccttgataaagaaccacctagaagcagcccccagcgaggggttcttgaaaagtca

SEQ ID NO: 2326 - DNA, 226 bp, Homo sapiens
  misc_feature (66)..(66): n is a, c, g, or t
  misc_feature (105)..(105): n is a, c, g, or t
aggtttcatttgtctttctgcatgtgtaattcagcctttaaattttaaatttttaaaaattattangctggacaggcagagttttcgtttgcctgttttgctcantgtttgtttacaaggctgggtgaaataaacagctttccagaaaacctccttctgacttaaaactcttttaggttggacagaaattcctgtccttgataaagaaccacctagaagcagcccc

SEQ ID NO: 2327 - DNA, 97 bp, Homo sapiens
aatgcctttgatggaccaattaccataactattgttaaccgtgatggcacccgctatgtccagaaaggagaatacagaacgaatcctgaagacatct

SEQ ID NO: 2328 - DNA, 175 bp, Homo sapiens
gtatgacacatattgcttcaatgcttcagctccacctgaagaagattgtacatcagtcacagacctgcccaatgcctttgatggaccaattaccataactattgttaaccgtgatggcacccgctatgtccagaaaggagaatacagaacgaatcctgaagacatctaccccagc

SEQ ID NO: 2329 - DNA, 183 bp, Homo sapiens
gaaagtggttgtgatcacaaagcacaacgatgatgaacagtatgcttgggagtcttctgctggaggttccttcactgtgcgtgctgaccatggtgagcccattggcaggggtaccaaagtgatcctccatcttaaagaagatcagacagagtacctagaagagaggcgggtcaaagaagtagt

SEQ ID NO: 2330 - DNA, 33 bp, Homo sapiens
gctccttccctaggagcatgggtggcacgtgcc

SEQ ID NO: 2331 - DNA, 147 bp, Homo sapiens
agggtgccggccctgccaccaagttgagagctggaggggaggtggggagagaacatcacagagcagccagccctggttcactcctggsagtttcttctcaagctccttccctaggagcatgggtggcacgtgcctgttggtctcagc

SEQ ID NO: 2332 - DNA, 34 bp, Homo sapiens
aaaagtagccggccgtggcggtgtgcgcctgtgg

SEQ ID NO: 2333 - DNA, 276 bp, Homo sapiens
aaggtacttagagctcttactttctaagtacagaacaccctagacaattcaaggcatcttaatctccatcaagaacaaaaaaaaaaataattttggtcatgcggttaaatccatcattagggataaaacgggtgcaaatgggtcaaagggatccaacaaacacggatgtccaagcgggcatatgggcaactattacgttaacggggggtcaatagagagttaaaaagatcttccctttcttctggttcttttccagggttctggaagagttctggt

SEQ ID NO: 2334 - DNA, 35 bp, Homo sapiens
aggcaggaaaaatcgctttgatcctgaaaaggtgg

SEQ ID NO: 2335 - DNA, 225 bp, Homo sapiens
gggactagagtttaactgcagcggaacatgtcatttctctatttctgtgacgcgcccccatgcccccaccccaccacaagaggcaggagggcccagtcatgaccctcgtctctgcagggtgtctgtacacgttcttctgaaagctttagacagtaacagtttgcacatgaaaaataaagcgagcacctaaacaatgtggtggagcataactaaaacccacagccc

SEQ ID NO: 2336 - DNA, 214 bp, Homo sapiens
  misc_feature (117)..(117): n is a, c, g, or t
tgaatggacttttcaactactttctctacagcttttcatgtaaattagtcttggttctgaaacttctctaaaggaaattgtacattttttgaaatttattccttattcccctctggncagctaatgggctcttaccaagtttaaacacaaaatttatcataacaaaaatactactaatataactactggttccatgtcccatgatcccctctct

SEQ ID NO: 2337 - DNA, 110 bp, Homo sapiens
aacacaaaaaccttctaatctagagatacttactaatctcattacatgagaatgctatgctgtagtgtactgggatatcactgaataccaatcatgatccaagatataga

SEQ ID NO: 2338 - DNA, 237 bp, Homo sapiens
ttaagactgattctggaggtccatcagttctcaagagacgccagtgtggccgaggcctggctgcttggacaggagccgtacctatccagccgagagataggccagagcgtggacgaggtggagaagctcatcaagcgccacgaggcatttgaaaagtctgcagcaacctgggatgagaggttctctgccctggaaaggctgactacattggagttactggaagtgcgcagacagcaa

SEQ ID NO: 2339 - DNA, 54 bp, Homo sapiens
aagcacatttttgagccatgtctgggtaccatggtggcggaatgcttggggacc

SEQ ID NO: 2340 - DNA, 294 bp, Homo sapiens
gggcctgaacataatttcaagaggaggatttataaaaccattttctgtaatcaaatgattggtgtcattttcccatttgccaatgtagtctcacttaaaaaaaaaaaaaagaaaagaaatggataatttcatctactgcctttacttgggggttaatgtgattcttaaacaccttcatcatggaactctcagagtgggggtccgtttttgttttcctggtgggggggtttttgaaagaataaggaaaagcacatttttgagccatgtctgggtaccatggtggcggaatgcttg

SEQ ID NO: 2341 - DNA, 141 bp, Homo sapiens
ctggcctgcaggaaaggagcgcccagctgcgcgcctgggccgcccgtcgctcccagtgctgccgccctcgcgttgcctccatggctgccccgcaggcccctcggccctgccttttccgaggaaaaacggttcagctcggtg

SEQ ID NO: 2342 - DNA, 198 bp, Homo sapiens
aggtcgaggtggaagggagccgtgcgggcagcctcatcagcgctcacagagccatgcctggcctgcaggaaaggagcgcccagctgcgcgcctgggccgcccgtcgctcccagtgctgccgccctcgcgttgcctccatggctgccccgcaggcccctcggccctgccttttccgaggaaaaacggttcagctcggtg

SEQ ID NO: 2343 - DNA, 99 bp, Homo sapiens
atatcgaagtcctggcttttctcgttttctcacttgctctcttgttctctgtttttttaaaccaattttactttatgaatatattcatgacatttgtaa

SEQ ID NO: 2344 - DNA, 284 bp, Homo sapiens
gaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttat

SEQ ID NO: 2345 - DNA, 161 bp, Homo sapiens
aggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcg

SEQ ID NO: 2346 - DNA, 261 bp, Homo sapiens
accatggtgctattattaggcttgcttgttacacacacaggtctaagcctagtatgtcaataaagcaaatacttactgttttgtttctattaatgattcccaaaccttgttgcaagtttttgcattggcatcttttggatttcagtcttggatgtttgttctatcagacttaaccttttatttcctgtccttccttgaaaattgctgatttggttctgctccctctacagataatttatatcaatttccctacagcctttc

SEQ ID NO: 2347 - DNA, 106 bp, Homo sapiens
tgacctctcggctttcacttgggcagagggagccatttggtggcgctgcttgtcttctttggttctgggaggggtgaaggatgggggtcctgtacacaaccaccca

SEQ ID NO: 2348 - DNA, 103 bp, Homo sapiens
tgacctctcggctttcacttgggcagagggagccatttggtggcgctgcttgtcttctttggttctgggaggggtgaaggatgggggtcctgtacacaaccac

SEQ ID NO: 2349 - DNA, 282 bp, Homo sapiens
tttcactctcctccgtctggttttggcactaggtatttctaacgcccgcgacactaatttacaaaatgggaatttacctggcgaaaacttgcccacggctcacccaagcaaggggcctttttttctggagatggctccctttaattatccccaattttttaaagggaccccacttggtttaagcctggtttctaaaaaggtgccttaaaatttgtggagggatttttttttcccccccacccctccaaagggctctccagcagttcaaattagcccggcggg

SEQ ID NO: 2350 - DNA, 247 bp, Homo sapiens
  misc_feature (31)..(31): n is a, c, g, or t
tgcagcataacgaccacacaaaccaccacanatattgtcccccccttgcgccccccccccttcctcccctttcatccccggtccttatccacaaccccccccgggggaacatgctcttccaataatcccctcccctccttacccacgggggcctaacaaggtaaggtggcaaaataacctcccccgccgccccccttttatttaaacacccctgtcccggccgaaaactctgccatgcgtgccaccc

SEQ ID NO: 2351 - DNA, 280 bp, Homo sapiens
gtcagaagttgataggttgttaaatacatttatataatacattaaatatgtgaaattaatacaccttcctacattttgaaggtgatgcatagatcccatagtgtgcatcatgttccttatatgaaaacgtttaaattactgggtcttttccattaaactacttttgtatggcttagataaatcttccattagtgttcatttttatagaattatgctgttaaaactactttaggtgaacaaataaacttgtctattatatattaacgcgactgaactacag

SEQ ID NO: 2352 - DNA, 253 bp, Homo sapiens
caggtgtccgcatttttgcatggtaaggaaaaggcttacttgcccttcagctcataaaagcagaaggtgtgctattcacagtaccatgcgagtagcccacagttaattcccggcagattctttggctgtgttttatctttaatgaacgtttctgactaatattttgttgtaaaccattaagtaatgtaacgcatgtaagatgcttagggtgcctggccaggactccgtggtttcctgttgtgacagtaataat

SEQ ID NO: 2353 - DNA, 220 bp, Homo sapiens
gagctaacgtactactgctgcaagaaggacctgtgtaactttaacgaacagcttgaaaatggtgggacatccttatcagagaaaacagttcttctgctggtgactccatttctggcagcagcctggagccttcatccctaagtcaacaccaggagagcttctcccaaactccccgttcctgcgtagtccgctttctcttgctgccacattctaaaggctt

SEQ ID NO: 2354 - DNA, 119 bp, Homo sapiens
gatagcagggcatgaaaacttagagaggtacaagtggctgaaaatcgagtttttcctctgtctttaaattttatatgggctttgttatcttccactggaaaagtgtaatagcatacatc

SEQ ID NO: 2355 - DNA, 264 bp, Homo sapiens
tgctaactcctagctgactcagcatagattgtataaaatacctttgtaacggctcttagcacactcacagatgtttgaggctttcagaagctcttctaaaaaatgatacacacctttcacaagggcaaactttttccttttccctgtgtattctagtgaatgaatctcaagattcagtagacctaatgacatttgtattttatgatcttggctgtatttaatggcataggctgacttttgcagatggaggaatttcttgattaa

SEQ ID NO: 2356 - DNA, 211 bp, Homo sapiens
agcagattacctcagaatcctgtctggtggcagaattcagtaaaaaaaaaaagtgggtgggggacctttctttcagtgcttaagaaatatttacttttttgtctgcgaattttgaatacccatgctcattgacgttagccaacgcccttatagagagactggctctgagatccgtaggcccaggcgctctcacttgacagataccggtagg

SEQ ID NO: 2357 - DNA, 65 bp, Homo sapiens
aagaaggttataacgatggagaggtagatgacgaggaagatgaagaagagcttggtgaagaagaa

SEQ ID NO: 2358 - DNA, 146 bp, Homo sapiens
ggaggatgaagaaggttataacgatggagaggtagatgacgaggaagatgaagaagagcttggtgaagaagaaaggggtcagaagcgaaaacgagaacctgaagatgagggagaagatgatgactaagtggataacctattttgaa

SEQ ID NO: 2359 - DNA, 210 bp, Homo sapiens
ttgcagcatattcttctctttggcccagaggtgggttaaactgtaagggacagctgagattgagtgtcagtattgctaagcgtggcattcacaatactggcactataaagaacaaaataaaataataatttataggacagtttttctactgccattcaatttgatgtgagtgccttgaaaactgatcttcctatttgagtctcttgagac

SEQ ID NO: 2360 - DNA, 117 bp, Homo sapiens
taaacactatcctgggcgcagccccgggccaccgccgagtgacgccaaagccctggttgactctgacagccccgtgggtgtgtgggaggccgggcgctctggggtctgtctgtcagt

SEQ ID NO: 2361 - DNA, 205 bp, Homo sapiens
aaagccctggttgactctgacagccccgtgggtgtgtgggaggccgggcgctctggggtctgtctgtcagtgcaatcgtttagtgttttttcagtggggcggggcgggaagcgggtgggaccgggcagccagttctcaaaggctgtggggccgactggaggccacagcccctcacccctagacgttgccaaccagaactgacgtg

SEQ ID NO: 2362 - DNA, 178 bp, Homo sapiens
tggtggtgagttttcgccatctccttgcgctggttggctagggcttcttcatatgacgtttccttcatggagaaagtcgacaccaggaagatgccaatggcagaaacaaccatgaatcctccaaagaccacaacccccaaggtttgagtgtcgtaaatatccatcctggcttgctttc

SEQ ID NO: 2363 - DNA, 92 bp, Homo sapiens
ccatgagagaacaagtctccttagagccacaagaagtagacccttcccagagcccccagttttgtaaaatgaaaccctgtgctccccatttt

SEQ ID NO: 2364 - DNA, 111 bp, Homo sapiens
ccatgagagaacaagtctccttagagccacaagaagtagacccttcccagagcccccagttttgtaaaatgaaaccctgtgctccccattttggataaaccactaatcccg

SEQ ID NO: 2365 - DNA, 172 bp, Homo sapiens
ttctgactttaatctaccccaaagcaaaatgacctggacctggttcaagggagggaagtgaaccttgaaactgttttggccaataaccttaacaaacaaaatgatatttaccaaaagaagtgttgcaaatagtctcatgagttaagagcttgatttaatggatcttcttttt

SEQ ID NO: 2366 - DNA, 172 bp, Homo sapiens; identical to SEQ ID NO: 2365

SEQ ID NO: 2367 - DNA, 166 bp, Homo sapiens
gaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttag

SEQ ID NO: 2368 - DNA, 40 bp, Homo sapiens
cgctctttcccttcattgtggggcattgttcgggcccttc

SEQ ID NO: 2369 - DNA, 169 bp, Homo sapiens
cacttaccaggatcagccctggcatgccgattgctttgtgtgtgttacctgctctaagaagctggctgggcagcgtttcaccgctgtggaggaccagtattactgcgtggattgctacaagaactttgtggccaagaagtgtgctggatgcaagaaccccatcactggg

SEQ ID NO: 2370 - DNA, 241 bp, Homo sapiens
cccacagtaccgagaaacacaagaggcacaacacacaagaccaagaacacaaaggagggcgggcgccacaaagtagacaccaagcaggaggcgacaagaacacaggaccacagagtgtacaaaaaagaggccctacatagcgacagaaatacacgagagcagacgggcccgagatcacacgcagacggcgaaaagcagagtggggcctgagaagacacatcccgcgggagatcacagacca

SEQ ID NO: 2371 - DNA, 213 bp, Homo sapiens
aatctatttagatcgggctgactgtacaaatgactcctggaaaaaactcttcacctagtctagaatagggaggtggagaatgatgacttaccctgaagtcttcccttgactgcccgcactggcgcctgtctgtgccctggagcattctgcccaggctacgtgggttcaggcaggtggcagcttcccaagtattcgatttcattcatgtgatta

SEQ ID NO: 2372 - DNA, 148 bp, Homo sapiens
gatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgt

SEQ ID NO: 2373 - DNA, 169 bp, Homo sapiens
gatttttttgccaatagtttatagaaaatatatgaaccaaagtgatttgagtttgtaaaaatgtaaaatagtatgaacaaaatttgcactctaccagatttgaacatctagtgaggttcacattcatactaagttttcaacattgtgttctttttgcattcatttttta

SEQ ID NO: 2374 - DNA, 139 bp, Homo sapiens
caacggcagcgtcccggcccgccgaacaaagaggaagcccgcgggccgccgggaagcggggggcggccttcacccctccctcgggcccgaaaaaagggtgaagtcgggtcccgccgaaccgccatgccctccctaaagg

SEQ ID NO: 2375 - DNA, 78 bp, Homo sapiens
  misc_feature (42)..(42): n is a, c, g, or t
gaatgtactttgctttacaaaatgctataactctgcttaggngtctattttcttgagccactaaagcgaaaataatgt

SEQ ID NO: 2376 - DNA, 194 bp, Homo sapiens
  misc_feature (139)..(139): n is a, c, g, or t
attttaaactcaaccaagctgtgataagtggaatggttactgtttatactgtggtatgtttttgattacagcagataatgctttcttttccagtcgtctttgagaataaaggaaaaaaaatcttcagatgcaatggttntgtgtagcatcttggctatcatgttttggaaatactggagaagctttgaccaatt

SEQ ID NO: 2377 - DNA, 71 bp, Homo sapiens
aactcattgaattaacttgcagtggtgtgtttgattcttttttagactggcttcagcattgtgcagtttaa

SEQ ID NO: 2378 - DNA, 223 bp, Homo sapiens
ctaaagtgtcagttggtggttttgtgaactggtcaaaaattcacaggtcttaaatgttttgggggaaatttatattggacactgctctttgtctagcaaataaaagatgttaatatattcctgttactggcatgtgcacgactatgttattagaagccactttatcattttcctgctttaaatagaaatgtctatttatgaattctgcttgtagttttttcac

SEQ ID NO: 2379 - DNA, 259 bp, Homo sapiens
gtgccttttatagctattactgtctggttttaacaatttcctttatatttagtgaactacgcttgctcattttttcttacataattttttattcaagttattgtacagctgtttaagatgggcagctagttcgtagctttcccaaataaactctaaacattaatcaatcatctgtgtgaaaatgggttggtgcttctaacctgatggcacttagctatcagaagaccacaaaaattgactcaaatctccagtattcttg

SEQ ID NO: 2380 - DNA, 288 bp, Homo sapiens
ggttactttcacatacagccctcccccagcagttgaatgacaacagaagcttcagaagtttggcaatagtttgcatagaggtaccagcaatatgtaaatagtgcagaatctcataggttgccaataatacactaattcctttctatcctacaacaagagtttatttccaaataaaatgaggacatgtttttgttttctttgaatgggcttttgaatgttatttgttattttcagaattttggagaaattatttaataaaaaaacaatcatttggctttttgaatgctc

SEQ ID NO: 2381 - DNA, 247 bp, Homo sapiens
taaaatggaagcggttggactgatggtgtctgaggttctttcccacactgaaattctaaatattgacacttagcagtcatagggctgataatacacacagttactgacttagcctaaacaacctggtgcatcgaaatgtaatcaccctttcttttgtaaaagagacccatcttctatcttcctttcccaccttttctctgtttttatgaaaacccaactgttggacattccaaaccattggatttga

SEQ ID NO: 2382 - DNA, 79 bp, Homo sapiens
attgacacttagcagtcatagggctgataatacacacagttactgacttagcctaaacaacctggtgcatcgaaatgta

SEQ ID NO: 2383 - DNA, 295 bp, Homo sapiens
catcccagtctgatattcacctaagtttccggacccttttccttagctgtaaaatggaagcggttggactgatggtgtctgaggttctttcccacactgaaattctaaatattgacacttagcagtcatagggctgataatacacacagttactgacttagcctaaacaacctggtgcatcgaaatgtaatcaccctttcttttgtaaaagagacccatcttctatcttcctttcccaccttttctctgtttttatgaaaacccaactgttggacattccaaaccattggatttg

SEQ ID NO: 2384 - DNA, 262 bp, Homo sapiens
ctggggctataattctgtcctggaaaaagaactctgaaaacctgggtcaggggaatgattcctaaggaaaacggtctgcatttgagctctggtttgaaagtagccaaggggactgatggtggacactccagatgtggttggaagcatatgtggggaggctggctggctgagttttgttattttctgtatagaaaggttgagatatatcaacacttgggattgttacccatctgcagaattgacttctcaaataaagatgcta

SEQ ID NO: 2385 - DNA, 296 bp, Homo sapiens
gaggcagagcctgagtcaccggtcacccttaatatttattaagtgcctgagacacccggttaccttggccgtgaggacacgtggcctgcacccaggtgtggctgtcaggacaccagcctggtgcccgtcctcccgacccctacccacttccattcccgtggtctccttgcactttctcagttcagagttgtacactgtgtacatttggcatttgtgttattattttgcactgttttctgtcgtgtgtgttggggatgggatcccaggccagggaaagcccgtgtcaatgaatgccg

SEQ ID NO: 2386 - DNA, 245 bp, Homo sapiens
ggtgccatattgctttgtataagttattttccatcaaggatttgtgtctgctttgtgtgctgctatataataattatgtcttgctgaagttcttctgcttattgaattcctctactgaagttccttacttattcaaataagtaaggtaggaggtacttagtcaattgagcagctaattggctaaaagtgtcttgagcacaagataagcatgtactgaaaaactgagtatctcttgtccattgtta

SEQ ID NO: 2387 - DNA, 126 bp, Homo sapiens
tgaaattcagaattccgtttccttctaactaatgaaaaactgcttactaaaaaaaaattttatactttccttgctaaggtcccatatattgatttgtacagatccacttagtcattttctcctttt

SEQ ID NO: 2388 - DNA, 233 bp, Homo sapiens
tgaaattcagaattccgtttccttctaactaatgaaaaactgcttactaaaaaaaaattttatactttccttgctaaggtcccatatattgatttgtacagatccacttagtcattttctcctttttttaagaaccattttcatctgatttttaaactcacgataccagttatctgttaatcaaaattgcattttacaatttaataatgtgatatttcctatgtctacagcat

SEQ ID NO: 2389 - DNA, 290 bp, Homo sapiens
acctagcggacgtctctctataaaagcgagagtgacgcgcccggtgtaaaaaccaacgcacggggacagcagagacaaactatgtctcctagtggtgcatcacctttgagaaggaacacacatcatacggcgtggcggagacacacatataggaaaccacccctcaacgcaggtaataagtggccaggagggaacatatacagctcgtgagaggcatattaggggagcagccgaccccgctaccctctgcccggcgtcaaaaattatccatggcggattctgtgaactca

SEQ ID NO: 2390 - DNA, 113 bp, Homo sapiens
taaatattgggccattaaatggtaaataaacttttaataaaaccgttttattagcaagttacaccagaaatttcaatcccctaggtatatatagtaccctcaagtatttatta

SEQ ID NO: 2391 - DNA, 221 bp, Homo sapiens
  misc_feature (52)..(52): n is a, c, g, or t
  misc_feature (78)..(78): n is a, c, g, or t
  misc_feature (171)..(171): n is a, c, g, or t
ccgcgcagccgccaaagtctcgagggccacgtgctgagcgaagcgcgcgaanctggtggcccttctgggggcccgcancgcggacggggccttcctccgacccagggcgctgaaccgtcctggccgtggccaacctcttgaatggccgtggggtttcggctggcgctaacnccccaacaaaccccaagtcccggggagtcgctcccccacacaacaaaaag

SEQ ID NO: 2392 - DNA, 194 bp, Homo sapiens
aaagctgtgtttatatggaagaaagtaaggtgcttggagtttacctggcttatttaatatgcttataacctagttaaagaaaggaaaagaaaacaaaaaacgaatgaaaataactgaatttggaggctggagtaatcagattactgctttaatcagaaaccctcattgtgtttctaccggagagagaatgtatt

SEQ ID NO: 2393 - DNA, 36 bp, Homo sapiens
atcctggtcaggaaatgacatgttaatgctttgctc

SEQ ID NO: 2394 - DNA, 240 bp, Homo sapiens
acacatcctggcatcgcactgttagcatttaatttcttgttaggattcagggaaggaacagttggccaagaattttttttcttttaaacaagccaaccacctagctggtaattaatgaggttcacttaaaaaaaaaattcggtgcacacagactgacatgaaacctgggtgctacagtaaaagaaaacaaaagtccagtttgtgtctcttaatcgctcacttcaactcatttcttctaaa

SEQ ID NO: 2395 - DNA, 284 bp, Homo sapiens
taaaaagtgattcttgcacatgaactgtcacatgtttaaaaatgtgttttttagagagcctcagtcttactgatttcaaacacttttttcttctgtgtattgcttttaagagagccatcagttagctatcagactctaggttgatgcattttgtacttagctgtactgtgtgatatttttcattattttaggacgccaacatgagacctgtaataaaatatgtaatggggttgaaagctggggaggaggatctactgctgtacagctaataaatcataacggat

SEQ ID NO: 2396 - DNA, 41 bp, Homo sapiens
aaatagaattgacctccagcccggattaggcataaattttg

SEQ ID NO: 2397 - DNA, 149 bp, Homo sapiens
ggtgttctacctgtttgcatcaaaggaaaaaaagattttttttccaagggccaatttttttatcttttcccaaaaaaaatttgttaatggaacatttacaaaaatagaattgacctccagcccggattaggcataaattttggttggga

SEQ ID NO: 2398 - DNA, 293 bp, Homo sapiens
aagtgagtaaaatcccctagagcagagagagagagagagagagagagtgtcttcatgccaaccacagcctgtttctgctgagtttcttatcagccctcaagctatgctaggaaaagttataaaatgccaaaatatttataaacatttactttgtccataaaatatttacattggatactctgtaagtaggaggtactttgtcccaaaaagatgtataagaatgtactaatagttttatttgattaggattgaacagttcagttgtatctatgccccacagtgaccagtaaagt

SEQ ID NO: 2399 - DNA, 292 bp, Homo sapiens
caccccacttctctctaaggagaatggcccagtcctctcccaagtccacacaggggaggtgatagcattgctttcgtgtaaattatgtaatgcaaaatttttttaatcttcgccttaatacttttttattttgttttattttgaatgatgagccttcgtgcccccccttcccccttttttgtcccccaacttgagatgtatgaaggcttttggtctccctgggagtgggtggaggcagccagggcttacctgtacactgacttgagaccagttgaataaaagtgcacacctt

SEQ ID NO: 2400 - DNA, 255 bp, Homo sapiens
ttgtcttggaagtatctcataggtctttaaatgagtaaaacatttttatgccagaaggtgatataatggatgttagtgttttttattggattttacaggagttttagtcagataatgaggacagagacctccacttgaattctttaccaccatttcagcaatatttttttaatggcctttcacttggattttggcttaaataagggccccgaacaagatccaaaactttgtgtcctcagggaagggccattaata

SEQ ID NO: 2401 - DNA, 255 bp, Homo sapiens; identical to SEQ ID NO: 2400

SEQ ID NO: 2402 - DNA, 247 bp, Homo sapiens
aactcattcattagtcatgtttatctgcttaggagtttagggaacaatttggcaattttgtggttttcgagattatcgttttcttaaagtgccagtattttaaaatagcgttcttgtaattttacacgcttttgtgatggagtgctgttttgttatataatttagacttggattctttccatttgcatttgtttatgtaatttcaggaggaatactgaacatctgagtcctggatgatactaataaa

SEQ ID NO: 2403 - DNA, 191 bp, Homo sapiens
caagggattctcatggttcatgtgacttagaaagtccataggtaagtgctggctccaggtgaagcacttgaaccagtagttcagtatgtctctaaataccggactgacttttttctcactgttgcatcttctgtaggaccacttaagtctggccacttaatggttgcacattcctagattaccttttccca

SEQ ID NO: 2404 - DNA, 201 bp, Homo sapiens
ttaaaactaccaagggattctcatggttcatgtgacttagaaagtccataggtaagtgctggctccaggtgaagcacttgaaccagtagttcagtatgtctctaaataccggactgacttttttctcactgttgcatcttctgtaggaccacttaagtctggccacttaatggttgcacattcctagattaccttttccca

SEQ ID NO: 2405 - DNA, 106 bp, Homo sapiens
ccatggtgggtctgcccgccagctgggccttgggaattcgcccaccaaacgcctttcaagaaaaccttggttattgggccccggaagatgttcaacagcccaacaa

SEQ ID NO: 2406 - DNA, 45 bp, Homo sapiens
gcgcccctttttttatgtgacgagcaaaaccctcctttctccctg

SEQ ID NO: 2407 - DNA, 89 bp, Homo sapiens
tggtctcactgggagttcatggtgcttcagtccctagcacccagtgatacccccacaggtagccctaagcatcctgaaacatcatccgc

SEQ ID NO: 2408 - DNA, 267 bp, Homo sapiens
tgggcacttgccgacctgagtctggggccagggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcac

SEQ ID NO: 2409 - DNA, 172 bp, Homo sapiens
tttcatagtgtcacctaatctgcgtaaagccgccgcttcctttatgagggtaatgcttcagcaactgataaatacttgatggttggacaacccactaaagcatgaaaatgtttttggaattggagcatgcttatgacctaaacgcaaaaattaacacatgctcttttttcgt

SEQ ID NO: 2410 - DNA, 45 bp, Homo sapiens
tttctattgttgctgattccgagggatattccctataatgtatga

SEQ ID NO: 2411 - DNA, 294 bp, Homo sapiens
agttacctcatttttcccatgtatgtatttgagaaaatgctaatatatagagaaaaaaatggttcttaaagcttaaatgtgtggttttttccattccatgggattcacattggtttgtagcatttaacataactagtatgttgtattatatatatgtgtatactgattgaaatttttaacagatttgtactttttttaaaatgaaagttgctagttctgcttgaccaagtagtggcatcattatttttttttctattgttgctgattccgagggatattccctataatgtatga

SEQ ID NO: 2412 - DNA, 36 bp, Homo sapiens
taaaaacaaaaccgtgcgcattgtgggccccccttt

SEQ ID NO: 2413 - DNA, 188 bp, Homo sapiens
  misc_feature (74)..(78): n is a, c, g, or t
  misc_feature (80)..(86): n is a, c, g, or t
  misc_feature (88)..(88): n is a, c, g, or t
  misc_feature (97)..(98): n is a, c, g, or t
tatttgcagattcctcatcaaatctgtaattatgcacagttttctgttatcaataaaacaaaagaatcccaaannnnnannnnnnnanaaaaaaaannaacatgtccggccgccctcggccctcgaagaaactttctaggaaccttcgttttgggcgcgcgggccccagttaaggtaggtgaacatgg

SEQ ID NO: 2414 - DNA, 232 bp, Homo sapiens
  misc_feature (74)..(78): n is a, c, g, or t
  misc_feature (80)..(86): n is a, c, g, or t
  misc_feature (88)..(88): n is a, c, g, or t
  misc_feature (97)..(98): n is a, c, g, or t
tatttgcagattcctcatcaaatctgtaattatgcacagttttctgttatcaataaaacaaaagaatcccaaannnnnannnnnnnanaaaaaaaannaacatgtccggccgccctcggccctcgaagaaactttctaggaaccttcgttttgggcgcgcgggccccagttaaggtaggtgaacatggggccatagctggtttccctagggagaaccctgggccatgaacta

SEQ ID NO: 2415 - DNA, 48 bp, Homo sapiens
ccagtttattaatgccagtttcccgatggttggaaaggaaccattttg

SEQ ID NO: 2416 - DNA, 238 bp, Homo sapiens
gacagagggtgtcaaacattcgtgagctggggactcagggaccggtgctgcaggagtgtcctgcccatgccccagtcggccccatctctcatccttttggataagtttctattctgtcagtgttaaagattttgttttgttggacatttttttcgaatcttaatttattattttttttatatttattgttagaaaatgacttatttctgctctggaataaagttgcagatgattcaaa

SEQ ID NO: 2417 - DNA, 33 bp, Homo sapiens
ctttataagagatcctctgtaccaaaacaatga

SEQ ID NO: 2418 - DNA, 218 bp, Homo sapiens
atgaaaacaaaatgacttgtctttttatttgatagtgtaatatcattcattttataaattttttagggtttttctcgttgtaatattgtacagttttgcatggcctggtgtgatcattttttggttagaatataatgctgacaaatgtggatggaggggaagatactgtttagcctatcactccttattttattttgtttggttttatgccctcagtg

SEQ ID NO: 2419 - DNA, 167 bp, Homo sapiens
gaagccgcgcctgccaaggaggccaccagagggcagtgcaggcttctgcctgggccccaggccctgcctgtgttgaaagctctggggactgggccagggaagctcctcctcagctttgagctgtggctgccacccatggggctctccttccgcctctcaagatcccc

SEQ ID NO: 2420 - DNA, 231 bp, Homo sapiens
aagtcagatgtaatgtgaccctagaaaactgtagcaagcttcagaaataaatcttttgatctttccctatcttgattagatccaaagtcaaagcaaccatacttcacctagagaagacagtattggcaatcatgacacctgtaataaaaacttgaatccaaagtcaaaacttaagcaagatacaaatgtgctgcctgcagttagtcctgcatgggaataaggactagttat

SEQ ID NO: 2421 - DNA, 245 bp, Homo sapiens
agttggtgacctaaaggcttgttagtgatgtggagttcctacatgcagtgagtggaaaatgaagttcgttttctcttaggaaaatgggcagctgtcttctgcctaatgtgtatttttcatgttaattctgacagttcaccaaatagctagtcatggagaatgcaggcagttaacttaatatccctccaggaatggttcctacgttgtgtattatttggtttcttttacttacctgcttgaatact

SEQ ID NO: 2422 - DNA, 267 bp, Homo sapiens
gccctgaccccgatcagttaaggagctgtgcaataaccttcctagtacctgagtgagtgtgtaacttattgggttggcgaagcctggtaaagctgttggaatgagtatgtgattctttttaagtatgaaaataaagatatatgtacagacttgtattttttctctggtggcattcctttaggaatgctgtgtgtctgtccggcaccccggtaggcctgattgggtttctagtcctccttaaccacttatctcccatatgagagtgtg

SEQ ID NO: 2423 - DNA, 79 bp, Homo sapiens
aatgtaaataatcacgtattgtgggggagggggagtccaagtgtgcccctcctctcttctcctggctggattatttaaa

SEQ ID NO: 2424 - DNA, 177 bp, Homo sapiens
gggaaataaggcttgctgtttgttctcctggggcgctccctccaacttttgcagattcttgcaacctcctcctgagccgggattggccaattactaaaatgtaaataatcacgtattgtgggggagggggagtccaagtgtgcccctcctctcttctcctggctggattatttaaaa

SEQ ID NO: 2425 - DNA, 70 bp, Homo sapiens
ggaattgttactggtgtacttattctatcttccattttattatttatgtacaattttggtgtttgtatta

SEQ ID NO: 2426 - DNA, 74 bp, Homo sapiens
ggaattgttactggtgtacttattctatcttccattttattatttatgtacaattttggtgtttgtattagctc

SEQ ID NO: 2427 - DNA, 259 bp, Homo sapiens
gccgttcagcctggttagttttctacctactccgagtgtcctcccctgccccaccagattgctgcaggggcgcggtgtgcctggcagccaaattgttgacacttcttttttcctatgcactggttttacacagctgtcatttttctttcaaaattgcagcagtcccacagatgtgtgcatttggacaaatagtacttaaaaacaaaacaaacaagcactcagcccagctcctcaatactacctggaaaaagcattggca

SEQ ID NO: 2428 - DNA, 225 bp, Homo sapiens
tgaatgggtccattttgcccttccatagcctaatccctgggcattgctttccactgaggttgggggttggggtgtactagttacacatcttcaacagaccccctctagaaatttttcagatgcttctgggagacacccaaagggtgaagctatttatctgtagtaaactatttatctgtgtttttgaaatattaaaccctggatcagtcctttgatcagtataat

SEQ ID NO: 2429 - DNA, 77 bp, Homo sapiens
gaaaagtcattgatgggatgacagtggtgcactccatagagctccaagcaactgatgggcatgaccgtccactcacc

SEQ ID NO: 2430 - DNA, 245 bp, Homo sapiens
attgaacttacggactcgttaagcttgaagacaaaacaggggggggcgcaaagaacccaggagggccagctacacaacccgttctggtaaaggcgcacaaagggcgaaaaaagaagcgcgggtaacacagcaggaaaagcggtatcctaggacaactggtggatagcacccaaagagagcaacatgtaggaagcctgcgcacaggtagaacagcagcaaaagcagaacatcagcgacatagcaga

SEQ ID NO: 2431 - DNA, 43 bp, Homo sapiens
ctcaaaagattgtcgtaagaacaacaatgtcaagaccaaaaaa

SEQ ID NO: 2432 - DNA, 263 bp, Homo sapiens
ccggtaagcacgacgcaacgagcgacagacacagagccgacagcagacagaaagcgcaaaagagacaagcgaagacggcaaacaacgcggaggagagacggcaccagcccgaaggcgagagcaagcgcaccagcgacagaagaaggaaagcaagaaaccacaaacagacgagccaacaaaacaaaaaagaagagacaacaacagaggaacgacacagacagaaccagcacagaagaaacacaacagagaaacaacgggaccaa

SEQ ID NO: 2433 - DNA, 264 bp, Homo sapiens
atggaaacgagcacgggagatcacacccgcggggacggacgtaaagtccagagatgcaacccagcggagaagatggacagacatgacgtggaatgcggcaaagcggaaccagagcgacatctagagcggggaacggaccaaggaatcggggtcccaagacgttgggaaaaaggggcccagttgttaaaggccggtccactggagcggcccgggagaaaaaacatcttccactatacctttcaggttaaaccctgtgccttcaac

SEQ ID NO: 2434 - DNA, 168 bp, Homo sapiens
ctgatgtaagtgttgtggaaatagaagcaaatgacaaaaagccttttccagaagatctgaaatcattggacctgttcaaaaaggaaaaaattaatactgaaggacacagcagtggtattggggggtcttcatgcatgtcatcttctaggccaagcatttctagcagtg

SEQ ID NO: 2435 - DNA, 93 bp, Homo sapiens
atcccttgggggaactggtgatgaataattccatctttggattaaaaaagtgaaaatagtctcccataatttttgggaccaatgaagttgagt

SEQ ID NO: 2436 - DNA, 93 bp, Homo sapiens
ggatacagttattgatgaggcttggccactggatgttttcactaactacactctacaagtgaactccttgcccaggccagttagaaaatccct

SEQ ID NO: 2437 - DNA, 268 bp, Homo sapiens
actagaattatctcaaacgtacaatataatgtatttcagcaaaaaaaaaaaaaattgaaattacagattatttaaaacagtatcagttttctattccttcttgtataccgacattcttaaccgtcatagcagttgatgcaaaaaagccgcatgtcgtgtgttagtaagtgatgccagatacaaatggtttggtctgtagagttaatgtggagctgcactgtggctgcagcaagatcataatatgcgatctgtttaataaaggttagcc

SEQ ID NO: 2438 - DNA, 234 bp, Homo sapiens
catcttgtggctccccagtggtcagcggagaccccaaggaggatcacaactacagcagtgccaagtcctccaacgcccggagcacctcgcccaccagcgactccatctcctcctcctcctcctcagccgacgaccactatgagtttgccaccaaggggagccaggagggcagcgagggcagcgaggggagctttcggagccacgagagccccagcgacacggaagaggacgaca

SEQ ID NO: 2439 - DNA, 130 bp, Homo sapiens
aacagtaatagttattggtgtcacataaaactgatttgttttttacagccaaacctctgtcagtcagaggcattcattagttttatacatgtaatttgaaaatcactaaacctcgttttctcagcagcaa

SEQ ID NO: 2440 - DNA, 277 bp, Homo sapiens
gtgtcttcatcaaaagggtccccagctcccctgggagtcaggtccaaaagcggccctttaaaaccagcaagggaagactcagaaacataaagaccatgcaggggagatttcaagtttgccctttcctggagtggttttgaaacctgctgcgagcaggggaggcccaggtctctccaaaaatggtgaagaaaaaaaggaagataggaagatagatgctgctaagaacaccttccagagcaaacatacatcaggaacgagtcggcctcagggcactcct

SEQ ID NO: 2441 - DNA, 257 bp, Homo sapiens
gataagcttgctaaactttcagagtgccctgagacacttccagccatccctcctcctgccttcattggggcagacttgcattgcagtctgacagtaattttttttctgattgagaattatgtaaattcaatacaatgtcagtttttaaaagtcaaagttagatcaagagaatatttcagagttttggtttacacatcaagaaacagacacacatacctaggaaagatttacacaatagataatcatccttaatggga

SEQ ID NO: 2442 - DNA, 292 bp, Homo sapiens
  misc_feature (267)..(267): n is a, c, g, or t
tgatcaccccactggcaggacaattcacagttcttgagcaaactgagttagggagggtatgctaacgacagaacctatgcaagttcttagaaatattttttgtttgctgaaataaagctcaatcaacacactaccttaaaaaaaagtgggagcagtggcatttccatgcctcatgctcaccatcatgaggttaacttcccgccgtcgcctcttgcctgccaggggtttttcgggagcccctctctgttccactctgattccttttgnttctttgctgaccattcactctctg

SEQ ID NO: 2443 - DNA, 160 bp, Homo sapiens
gttagtatagaattctcgaaacttgggaattcacaaatcaggactggggactgcgagaccacaaatttctgatcgcatttctgatggatgtgtcacaccttttctgtcaaaactaacatgtcttggaggttaatcgacgtcccttgggtggacacacaca

SEQ ID NO: 2444 - DNA, 160 bp, Homo sapiens; identical to SEQ ID NO: 2443

SEQ ID NO: 2445 - DNA, 267 bp, Homo sapiens
ggtggcagacatgtccaaggaatattgcggggatttgatccctttatgaaccttgtgatagatgaatgtgtggagatggcgactagtggacaacagaacaatattggaatggtggtaatacgaggaaatagtatcatcatgttagaagccttggaacgagtataaataatggctgttcagcagagaaacccatgtcctctctccatagggcctgttttactatgatgtaaaaattaggtcatgtacattttcatattagactttttg

SEQ ID NO: 2446 - DNA, 215 bp, Homo sapiens
ggagaaagctccctccgttctgatgcttttgagcttatcagggacaccctgcagcagaaattccagctgatccttcagccttcagagttgatgaggtggggctcacacacatctggatttgaagaagaatcgtgggtttcaagaactctgtggtctcttaagcattggtattccacagctacacttccctgatactttgcactcagtaatgacaa

SEQ ID NO: 2447 - DNA, 162 bp, Homo sapiens
tcatgccacccactctaccagttgtccccaccatcccccgccctccttcctgtgagacactgggccaaaggctcactacccctgtgcgttgtccagcacacagacactatgtgcattatttgtacataaggataatcacatctacctgagactgctatcatg

SEQ ID NO: 2448 - DNA, 249 bp, Homo sapiens
agttattttactcatgctgtgttttttaatataagctttacaaaaaaagatgcattcccttcctgttcacactcttaccatgtttttgttcttccttaagaatgattgtgtgtgtgtgtgtgtgtgtgtgtgtgtgtaagtgtaacatcatgggttttctttcttcacttgtaaagttttatctagaaatacttttacaggttatgttgaggtacacaaagataatgttctaagattgtgtattggatt

SEQ ID NO: 2449 - DNA, 276 bp, Homo sapiens
tgagccttgtatggagtgatgtttcatttacctgggttgtgttaatgactgaatgttgaccataaatctgttttatactgactgaagtttgtcatttttaagttccttgtaaccatcttgcgcgcatattcaccattgaactattctttcccaatataaaaatacacgaacacacacactttttctggccctctggcccctctaaaaaatttttttgacaccaatcgttgggcggcggccccgtgtgtttggaacaagtgtgaacaaggttccaaa

SEQ ID NO: 2450 - DNA, 224 bp, Homo sapiens
aagcaccataactttgtttagcccaaaaccaagtcaagtgaaaaaggaggaagagaaaaaatattttcctgccaggcatggtggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtccca

SEQ ID NO: 2451 - DNA, 181 bp, Homo sapiens
gtgggtataaatatctacaagtatacacacatatgtacttgtattccactattgtaacctgaaagaaagactatgtattcccttttttaattccgtactggtatttgtgttatttaaaaagcaaaattctgctctatttagttgtataatattagaggatactttgctgtgcacaattcca

SEQ ID NO: 2452 - DNA, 152 bp, Homo sapiens
gaggttcccaatgtttcgtccagaaaagtactttatttatgcaagtcaggtgactcttaggccacaaaaccatttgatgataaacagattatcattaggtgcatatcttattgatattttgtgaaatgttatgcctatgttgcaaaagttga

SEQ ID NO: 2453 - DNA, 280 bp, Homo sapiens
aaccaccttgcgtgggttcaagaagagtggaactccaggaaaaactggtggccaggctttcatttcagctacttttgggcaaaaagtgattggaaggaagatacagctttggcctgtgagaaagcttttgtggctggtttactgttaggaaaaggttgtagatatttccggtatattttaaagcaagatcaccaaatcttagggaagaaaattaagcggatgaagagatctgtgaaaaaatacagtattgtaaatccaagactctgatactgaattttag

SEQ ID NO: 2454 - DNA, 265 bp, Homo sapiens
acattttcttttcacgttaagcatactgggtatctgtgtctttcacaacaagcatttttaaaagaaaactcaatgcacaaatgggttaattagtataaaagtgctaagggctgtttgaaaagttaccactatagtatacagtcagttatatttgaggcatactacaacaaacttccagcttattgtggacaatattccagtagttgtttcaaaccattgtttgaaaaaaaaaaaaaaaaaatccaggagctgattagtgatgcag

SEQ ID NO: 2455 - DNA, 159 bp, Homo sapiens
tctcaaccttaggcagtaatagacatcacaaactgccatggttttgcactatgattataatacctgcatttctaattttttaagcatgtagccagtaataatttgaagttttttttctatgcaagcttaccttgttggcattatttttagggagttgaa

SEQ ID NO: 2456 - DNA, 158 bp, Homo sapiens
ctcaaccttaggcagtaatagacatcacaaactgccatggttttgcactatgattataatacctgcatttctaattttttaagcatgtagccagtaataatttgaagttttttttctatgcaagcttaccttgttggcattatttttagggagttgaa

SEQ ID NO: 2457 - DNA, 127 bp, Homo sapiens
  misc_feature (29)..(29): n is a, c, g, or t
  misc_feature (69)..(69): n is a, c, g, or t
gggctcttggactgatataaaactttgtnaaatgtagttctttgaatggagcttgaaacgccgcatatncttgctcccacaaggatagtgggcatcatgaattaataaaacgtcctaggattctgca

SEQ ID NO: 2458 - DNA, 48 bp, Homo sapiens
acaaactagtggtgggggcacagcagagcccacgaaaagaagttttgt

SEQ ID NO: 2459 - DNA, 288 bp, Homo sapiens
gagatcacttccagcctaatgtgcatttggctggaatatggttgtctcagaataacatcatgcactcgggcttttatacttctgcctttaggggactgtggcagcatggcatgggtcaagaagtacttctccttcatcttcctttgatgtcggtaactcatcctttctgcactgcgggagttgttaatgcttttgtgtcctccagttcacatgctgattgctaagaagaaaatgagcatgagtgaacccaaagctgctgaaacattctgcgtttatgcaacttccttg

SEQ ID NO: 2460 - DNA, 219 bp, Homo sapiens
gatctgatgggctctaacagtgcttactgcagccttgtgtccaccaccaacttctcagcatgtttctctccttggaccttgggtttccaactctgcagccttcaggtctggggccaggagtgggacccaccatttgtggggaaagtagcattcctccacctcaggccttgggtagatttggcaaaagaacaggagcagcataggctgtttgagctttgg

SEQ ID NO: 2461 - DNA, 78 bp, Homo sapiens
aaaccgtgttcgacgaggccatccgggccgtgctgtgccctcagcccacgcggcagcagaagcgcgcctgcagcctcc

SEQ ID NO: 2462 - DNA, 274 bp, Homo sapiens
agcagaaacctgcaccaaggattgtccctatgtcttggcccctcctagagcgtgtgcagactgatgattttatatgtaaatcaagactcacatccctttcctagtcccccacatccaaagcccctcagcctgccttgcagaccaatgggctccatgttctgtagccccctcccctacgcctcacccctcctccctctcacaggttctgggcggccagtgagagaaacgcagtgggggaggcagggagtctggtgcctgcagagattctctgctt

SEQ ID NO: 2463 - DNA, 264 bp, Homo sapiens
atgacagatgattttgttcaggaattttgctgtttttcttagtgctaataccttgcctcttattcctgctacagcagggtggtaatattggcattctgattaaatactgtgccttaggagactggaagtttaaaaatgtacaagtcctttcagtgatgagggaattgattttttttaaaagtctttttcttagaaagccaaaatgtttgtttttttaagattctgaaatgtgttgtgacaacaatgacctatttatgatcttaa

SEQ ID NO: 2464 - DNA, 180 bp, Homo sapiens
aaaaaactgggctgttcaatctcctttccatttttaaaaacctattttgaaaaaagctaaaaaaaaactattatggcctccctttagggggggtttatttttaatcccccgctttttttattcactttttaaaaattaaaaagttaaaaaaaaaaatggaagcacccctggctaaaaaat

SEQ ID NO: 2465 - DNA, 226 bp, Homo sapiens
gtgtgtgtacatatggaccacttcaagctacacacacacacacacacacatatacacgtgtatgaatatatatatatggctataagtggtgcgacttgcaggtactccctttgttcacctttgtaaagatgttattgccagttcagtgtgtatttctatagtatatatgtaaacaatttgtcatccttttgttgctgcttttgaaactagttcatggcttcagtgg

SEQ ID NO: 2466 - DNA, 247 bp, Homo sapiens
attttagtagaagtaatgtgccagtagagacaactgatgaaataccatttagtttctctgacaggctcagaatttctgaaaaatgacctccttgtttttgaaagttagcataattttagatgcctgtgaaatagtactgcacttacataaagtgagacattgtgaaaaggcaaatttgtatatgtagagaaagaatagtagtaactgtttcatagcaaacttcaggactttgagatgttgaaattac

SEQ ID NO: 2467 - DNA, 81 bp, Homo sapiens
atacagcaggccatagaccccaaaaatctcagccgacttttcccaggatggaaagcttgggtgtgatcttcagtatatgaa

SEQ ID NO: 2468 - DNA, 288 bp, Homo sapiens
tgctatagcgccattcccaaggcatcctcggacgccagcaaggtgacctctaagggggcagggctctcaaaggcctttgtgggccagaagagttccttcctggtggactgcagcaaagctggctccaacatgctgctgatcggggtccatgggcccaccaccccctgcgaggaggtctccatgaagcatgtaggcaaccagcaatacaacgtcacatacgtcgtcaaggagaggggcgattatgtgctggctgtgaagtggggggaggaacacatccctggcagccct

SEQ ID NO: 2469 - DNA, 103 bp, Homo sapiens
tctcctgcctgggttcggtttcagctcccagcctccacccgggtgagctggggcccacgtggcatcgatcctccctgcccgcgaagtgacagtttacaaaatt

SEQ ID NO: 2470 - DNA, 287 bp, Homo sapiens
  misc_feature (183)..(183): n is a, c, g, or t
agttactggtaccacagtgaggtgaataaaacgggattttcagaagttagcctgaatttaactgtatttttaaatttaacctccattaactaagcatcttttctttgtggtagggtctaccttctgcttccctggaaaggatgaatttacatcattcgacaagcctattttcaagttatttgntggttgtttgcttgtttttgtttttgcagctaaaataaaaatttcaaatacaattttagttcttacaagataatgtcttaattttgtaccaattcaggtagaag

SEQ ID NO: 2471 - DNA, 287 bp, Homo sapiens; identical to SEQ ID NO: 2470
  misc_feature (183)..(183): n is a, c, g, or t

SEQ ID NO: 2472 - DNA, 175 bp, Homo sapiens
ctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaa

SEQ ID NO: 2473 - DNA, 236 bp, Homo sapiens
ctttgggaccaccaagaggctctaggggtggcagagggggtcctgctcaacagcagagaggccgtggttcccgtggatctcggggcaatcgtgggggcaatgtaggaggcaagagaaaggcagatgggtacaaccagcctgattccaagcgtcgtcagaccaacaaccaacagaactggggttcccaacccatcgctcagcagccgcttcagcaaggtggtgactattctggtaac

SEQ ID NO: 2474 - DNA, 98 bp, Homo sapiens
ttccattgaacccaaaggtccgcaacacctgcctcccaggcctggggcggaaaaaattgaaacacctcctctccaccttgaatgggagccttcaaggg

SEQ ID NO: 2475 - DNA, 231 bp, Homo sapiens
  misc_feature (44)..(44): n is a, c, g, or t
tctactaagccgaaacccatctctactaaaattaccaaaatttncctgggcatgattgcgcatgcctgtaaatccagctacttttggaggcttgaggggggcagcaattgcttgaacctggggaagggggcaggtttccattgaacccaaaggtccgcaacacctgcctcccaggcctggggcggaaaaaattgaaacacctcctctccaccttgaatgggagccttcaag

SEQ ID NO: 2476 - DNA, 277 bp, Homo sapiens
tttcttccccgactgaaagatggctttgtccgttgagttgaaaactattaagtcctgccttcctcacttttcatcacgtggcttctgtttttgaattcctttttgttttcagtgatcccaccactagatatccacattgacagctatggtgaaaattatctaagcttcaccctgaccatggagagtgatatcaaggtaatgtgggaatttcaagccagcagctggatggggctttattttgtatgggaactgaaaggacatagcacagtaagactgg

SEQ ID NO: 2477 - DNA, 46 bp, Homo sapiens
tttttgctataatcattagttttagaggcattgttagtttagtgtg

SEQ ID NO: 2478 - DNA, 150 bp, Homo sapiens
agcagaatttttaatgtgaagacattttttgctataatcattagttttagaggcattgttagtttagtgtggtgggcagagtccatttcccacatcttttcctccaggatcctccaatttttatcatgaatttcccttttaatcaacctg

SEQ ID NO: 2479 - DNA, 240 bp, Homo sapiens
gagcagaggcaactcctggagctcagaaaagaaaaaaatcaaccaaagaaaaggctggacccaaaagggagtaaggtgtccgaagaacagactcagcctccctctcctgcaggagccggcatgtccacagccatgggccgttcccccatctcccaagacctcattgtcagctccaccccaaactttctcaactgagaaacccgaaaacagtggcccaatgtccaggtaaactcccagaaa

SEQ ID NO: 2480 - DNA, 289 bp, Homo sapiens
ccgtgtaggtctattggccagccaaggtcagacgaccctaagcatcaatagtaaacctcttggtcttctgattgctttatcactttttttttttttctgtaaaacaaaacaaaactcagaaatgttacagaatcagagtattaaaaaatgtacaagtgtatatgcttcccagacacacatggatacatttttcctccacattttcaccatggcagtattaagtagtgagtgtgaatgacacagcatgaaactggttactgaatcagctatgagctcagatggcctcaac

SEQ ID NO: 2481 - DNA, 33 bp, Homo sapiens
aacatgaacgacctcgtctctgagtatcagcag

SEQ ID NO: 2482 - DNA, 163 bp, Homo sapiens
gtatcagcagtaccaggatgccaccgcagaagaggaggaggatttcggtgaggaggccgaagaggaggcctaaggcagagcccccatcacctcaggcttctcagttcccttagccgtcttactcaactgcccctttcctctccctcagaatttgtgtttgctg

SEQ ID NO: 2483 - DNA, 259 bp, Homo sapiens
tggtgctgtgtgaccgcaagttctgcaccaaggcctaccacctgtcctgcctgggccttggcaagcggcccttcgggaagtgggaatgtccttggcatcattgtgacgtgtgtggcaaaccttcgacttcattttgccacctctgccccaattcgttctgtaaggagcaccaggacgggacagccttcagctgcaccccggacgggcggtcctactgctgtgagcatgacttaggggcggcatcggtcagaagcaccaa

SEQ ID NO: 2484 - DNA, 156 bp, Homo sapiens
cccgtagttttttctcctcatggatttgaatgaaatgccaataacacgtccactttcaacgtgtagtttacgcggagcactttcgaggcctggccgggttgggcctacttctcacctgggcctatcttctgaactcgctaggttcttatcaacatt

SEQ ID NO: 2485 - DNA, 293 bp, Homo sapiens
gtgttggacactgtgtatgagtattttgtttcaaaactttaacgccttttcttacgttaaaaacaaaaaggggggcgctaaagttctcccgagcgcccagtagcggtacccgctttccgtccacaggggccccatgagagccggaaataagcaaagacaggcgagtttaacagcggcgcgggaacccgcgccgtcgggacctgggaggaaccactccgggggacatggacacccagaagaagccggaaaaaaagggagctaaacgcactcgcgagtgctgtaaaacacacaag

SEQ ID NO: 2486 - DNA, 90 bp, Homo sapiens
ggaaagtctaatcctcaatcttttgggcacaagttttataagggccaaccaagcatggagtcagggaaaaataggatcgagggccacaaa

SEQ ID NO: 2487 - DNA, 246 bp, Homo sapiens
gcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaagtcaacc

SEQ ID NO: 2488 - DNA, 242 bp, Homo sapiens
gcgagcgagatctttggagagatttttttttttgcctcctacttctgtcttgaagccagacaatcgacttcagctctccctcccctccctctttctccacgttctgctcccactcgctctcctgtccccttcccctcccctcccggcggaaagccccccgaaaccaacaaagctgagccgagagaaacaaacaaaacaaacacaccgggccagacaagccatcgacaaaactttgcaaagtc

SEQ ID NO: 2489 - DNA, 272 bp, Homo sapiens
gaagggcctcgtgacacatcaggtcacatctccagtcaccttatttgtacacagttctctcctggaaaacctttcatttcttaagagtaaatgtgactagttagaggctaaaaaaaaaaaaaaaaagaaacaagagaccctgcccccgcaaaacggaattagaaggaaaagtacatctcagtgaaaccttgttacaaatgccaaggtttcccaggcctgtttccagggagagtagaatcttcctccacttccacgtaactcactgaattata

SEQ ID NO: 2490 - DNA, 253 bp, Homo sapiens
tctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaaga

SEQ ID NO: 2491 - DNA, 271 bp, Homo sapiens
aacagcagagaattgcgggttctacccagtcagaagatcacaccatggagactttctactagaggacttgaaagagaactgaggggccacaaaataaacttcaccttccattaagtgttcaagcatgtctgcaaattaggagggagttagaaacagtctttttcatcctttgtgatgaagcctgaaattgtgccgtgttgccttatatgaatatgcagtatgggactttgaaataatgattcataataaaatactaaacgtgtgtcttcaa

SEQ ID NO: 2492 - DNA, 182 bp, Homo sapiens
tacaacaaagtgacatcactacacttgttttgctgcatttattatcattttaaatctttaccatttttatgacaaaatattttgtactccagacgaagaaaaatgtgtgacatcatggattttttagacagttatacctttatctcmcatttataaagcatatcatggctgtgtatagttgc

SEQ ID NO: 2493 - DNA, 268 bp, Homo sapiens
  misc_feature (26)..(26): n is a, c, g, or t
  misc_feature (120)..(120): n is a, c, g, or t
atgttggtttaactgcaccctcctgnaggtagatttatttattaaaaatactggttgcatcaagacccatagggtgtacaaaaggtctataaaatctgcattatagagaaaaagaggcangcaaatccatgtcccaaggtaaaagctacagtttacaactgggaaccccagggtgaagatataaaaccccctcttgaaaacaaattgaaacaggggctgaaaacttgcgtggggcttcaaaattaccctggtcaaaatttcctgattg

SEQ ID NO: 2494 - skipped

SEQ ID NO: 2495 - DNA, 218 bp, Homo sapiens
atgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatctta

SEQ ID NO: 2496 - DNA, 135 bp, Homo sapiens
aagatcagcggaaacgttgaaaataactggaatgatcatctggggtgggccgctacgaacagaaccgcaaacaggatggcatgaatcttgccctggatatctgacattacacggactgtcactaacgatgacacc

SEQ ID NO: 2497 - DNA, 225 bp, Homo sapiens
acaggccctacatcattcgaggaatggcgcccccgacgacgccctgcagcaccgacgtgtgtgacagcgactacagcgccagccgctggaaggccagcaagtactacctggatttgaactcggactcagacccctatccacccccacccacgccccacagccagtacctgtcggcggaggacagctgcccgccctcgcccgccaccgagaggagctacttccatc

SEQ ID NO: 2498 - DNA, 292 bp, Homo sapiens
  misc_feature (255)..(255): n is a, c, g, or t
tcttcattttagaatgttatcttggtatgtttaaaaggaaaaacttaagatgtgttgcaattgcagtatgagtttcaggtatgtacatgttatgtgtgtgtgtgagagacacacacaaacacatttcaaacatgttttatgtttaagctcaatattcaaacacagaaatataacatctattcttaatatgttttatgtaagtacagcagcagcattattaaatactgtatttctatggtgattgaaaattagtangcagagaattttgtatgggtcttaatatttttgtata

SEQ ID NO: 2499 - DNA, 292 bp, Homo sapiens; identical to SEQ ID NO: 2498
  misc_feature (255)..(255): n is a, c, g, or t

SEQ ID NO: 2500 - DNA, 232 bp, Homo sapiens
gggcagcttgggtcttcttgggcacctctctgggaaaacccagggtgaggttcagcctgtgagggctgggatgggtttcgtgggcccaagggcagacctttctttgggactgtgtggaccaaggagcttccatctagtgacaagtgacccccagctatcgcctctagccttcccctgttggccactttccagggtggactctgtcttgttcactgcagtatcccaactgcag

SEQ ID NO: 2501 - DNA, 283 bp, Homo sapiens
actgtgtcccagtgtctggcccagccatggctggatgtgcatctggcctatgaccctgtgcctgtgtttcatgttctgtgtcacgtgaccctgtgccccgcctcccggggtgcccgtgtggcctgggtcctcggccctgtagccctggcccggtcccagtccggtgccttccaccctgccctggcctaccacagctgcctccgggcctcggcctggcttcaccgcattccaggggctgcagccccctgcttctcccgccattggccttaactggccctcgggc

SEQ ID NO: 2502 - DNA, 161 bp, Homo sapiens
gactgtgtcaagagtgagccacccagtctctaaagctaggaagcccccagtgtgccacgggaaacgcttgcctctcaccctgtttcccagcgccaacctccggggcaggcatccgggtggagagaggacttgtccctcgtgggtggtggttctttatagaa

SEQ ID NO: 2503 - DNA, 207 bp, Homo sapiens
gacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaa

SEQ ID NO: 2504 - DNA, 133 bp, Homo sapiens
cccaagtcacacaggggaaggtgatagcattggctttcggggaaattatgtaatgcaaaaatttttttaaatcttcggcctaaataccttttttaatttgggttttattttgaatggaggaagcctttcctgc

SEQ ID NO: 2505 - DNA, 228 bp, Homo sapiens
ccccactctctctaaagagaatggcccagtcctctcccaagtcacacaggggaaggtgatagcattggctttcggggaaattatgtaatgcaaaaatttttttaaatcttcggcctaaataccttttttaatttgggttttattttgaatggaggaagcctttcctgcccccccctttccccctttttttgtccccccaacttgagaaggattgaaaagctttttggc

SEQ ID NO: 2506 - DNA, 274 bp, Homo sapiens
ataccggctggccacgggaagcgatgataactgcgcggcattctttgagggacccccattcaagttcaagttcacagttggcgaccacagccgcttgtcaactgtgtgcgattctctcctgatgggaacagatttgccacagccagtgctgacggccagatatacatctatgacgggaagactggggagaaggtgtgcgcgctgggcggaagcaaggcccacgacggtgggatttacgcaattagttggagtcccgacagcacccatttgcttt

SEQ ID NO: 2507 - DNA, 276 bp, Homo sapiens
gggcgcggcgccaaaaagcagaccccgaagagagagccgcataggcacaagaggccacagccagataccaacggacaacaagctgggcaaacaaatggcgacacgaccgacggaaaaaaccacgaggagacacagccaacccagacgacaaacccgagacacgccgcccacaagacagggaaccacaagcaccccgaccgggaggcacactcaaaggacgccgcacccacccacacaggcaggagagcgccgaccgcggcaacaagagcacccaga

SEQ ID NO: 2508 - DNA, 275 bp, Homo sapiens
gataacagttactccagtatatgctgatggaccaggaagccctgaatccataaaggcataccttaaacaagctccaccttccaaaggacctactgttcggacaaaaaaagtagggaaaaacgaagctgtcttagagtgggaccaacttcctgttgatgttcagaatggatttatcagaaattatactatattttatagaaccatcattggaaatgaaactgctgtgaatgtggattcttcccacacagaatatacattgtcctctttgactagtg

SEQ ID NO: 2509 - DNA, 102 bp, Homo sapiens
ctacattccgttcatggggcacacccaggggaataagaataaaatgctattatgactaagttgtaaacctatgcacatcccttgcattttgggcaactttat

SEQ ID NO: 2510 - DNA, 154 bp, Homo sapiens
gaagtccaagccacaatgatcctgccaagaatcctccaggttaccttgagggtagttttgtaaaatctggagtcttcaatgtatcagaacttgtaagagtatccagaacgcccataacccaaggaactggagtcaacttcccaattggagaaat

SEQ ID NO: 2511 - DNA, 76 bp, Homo sapiens
atccagaaacctgaaatgaaggaagaggagactctgcgcagagcactttgggtccggaggcgagactccggcggaa

SEQ ID NO: 2512 - DNA, 131 bp, Homo sapiens
attcccgggcgggtgacccagcacggtccctcttggaattggattcgccattttatttttcttgctgctaaatcaccgagcccggaagattagagagttttatttctgggattcctgtagacacacccacc

SEQ ID NO: 2513 - DNA, 239 bp, Homo sapiens
gaaaccttgttcaacgcgtcccagcgcatcagcgagttagagaggaatgtggaagaacttaagcggaaagctgcccaaaactccggggaggcagaatatattgaaaaagtagtatatactgtgaagcaaagtgcagaagatgttaagaagactttagatggtgaacttgatgaaaagtataaaaaagtagaaaatttaattgccaaaaaaactgaagagtcagctgatgccagaaggaa

SEQ ID NO: 2514 - DNA, 90 bp, Homo sapiens
agagactgggaagataggctctgcacagatggatttgcctgtgccacccaccagggtgaacgacaatagctttaccctcaggcataggcc

SEQ ID NO: 2515 - DNA, 178 bp, Homo sapiens
gccaggcgtctacacgagagtctcacacttcttaccctggatccgcagtcacaccaaggaagagaatggcctggccctctgagggtccccagggaggaaacgggcaccacccgctttcttgctggttgtcatttttgcagtagagtcatctccatcagctgtaagaagagactgggaa

SEQ ID NO: 2516 - DNA, 254 bp, Homo sapiens
ggacaccatagcagacaagataaagaggcaagaaattgtccacgatcaaaaagagactatatacgacagtgagaaagagggtagcctataagatagcaaacggagggtgacaacaatctattaatgaacaatatttaacagagggagcacaaatagcaggataaaacaacgggtgagaataaaaaagtggagtagaaaaagagattagtagtacgagagaaaataggggtggaaaacccacagtaatagaacaa

SEQ ID NO: 2517 - DNA, 174 bp, Homo sapiens
gaaaattaatgcacaaaaccacttattatcatttgttatgaaatcccaattatctttacaaagtgtttaaagtttgaacatagaaaatratctctctgcttaattgttatctcagaagactacattagtgagatgtragarttattaaatattccatttccgctttggctacaa

SEQ ID NO: 2518 - DNA, 212 bp, Homo sapiens
gaaaattaatgcacaaaaccacttattatcatttgttatgaaatcccaattatctttacaaagtgtttaaagtttgaacatagaaaatratctctctgcttaattgttatctcagaagactacattagtgagatgtragarttattaaatattccatttccgctttggctacaawttatgaagaagttgaaggtacttcttttagaccacca

SEQ ID NO: 2519 - DNA, 250 bp, Homo sapiens
aatatattattcttcaacgacattttttgtaactttacacttttttggttattttattttaaaaaaatgaaaaattaatttaaaaaaatgcaaaaaactgttggattatttattttagaaattcccccctttgtgttggactgcaaattgagtttctttctctttaggcctttcacaactaggactgagaatgtatgtaaaagttctgtgacagtacagaaggaaaacaactttttatgtatagcttcta

SEQ ID NO: 2520 - DNA, 268 bp, Homo sapiens
agagaagttattttcgtacaggtggttttatacctgaagggaataaacgacaatgcaaaaataaacagatccgagcctctatctcagtacatgttgtcaggccgataatgtccgacctcgcgtttcgttttgcccgtgtttcccgtgaagcgtcggaattcggccttgaaaaccaataagggaattcctttagaagccagggctgaaaggggtagcgtaagtaaagaggtcaacctgcgaggtatcatgaccttgtaggttggcccgc

SEQ ID NO: 2521 - DNA, 71 bp, Homo sapiens
gggctcagccctgagttggcatcacctgcgcagggccctctggggctcagccctgagctagtgtcacctgc

SEQ ID NO: 2522 - DNA, 276 bp, Homo sapiens
acgcccgggaacacacactgtgctggggaggaagtgggcctaggagggcctgcaggtccaggcagctgtagagctgctagaagctggggtgttgctctccccgctttctcatagacacagaggtactgtctgcctgttgtcacacagttcatatgctcgcttgagatggaatctgaaccttggtcccaggatctgtgctttttcccactttgccacactgtctaaggtggctttgaactggaacccaagtgcaaataaaggttggtattcgctcct

SEQ ID NO: 2523 - DNA, 100 bp, Homo sapiens
acaaatggtgatatcaaagcaacgtataccccagtccagtgtgtgttgccataatttgcaattcagcttaacagtgcacccaatctatatttgcattttg

SEQ ID NO: 2524 - DNA, 142 bp, Homo sapiens
  misc_feature (33)..(33): n is a, c, g, or t
agctctttaaagggcaaaagcttatttccactnctcatccttttgtcctcctttagcacaatggtaaaaaagaataagtaatatccgaaccagggaagggagggaatgggctttgtctgggggaagcccaatccagggacaa

SEQ ID NO: 2525 - DNA, 123 bp, Homo sapiens
gacagggagagtcagcctccacattcagaggcatcacaagtaatggcacaattcttcggatgactgcagaaaatagtgttttgtagttcaacaactcaagacgaagcttatttctgaggataa

SEQ ID NO: 2526 - DNA, 260 bp, Homo sapiens
tttgtttaatacatgtggaccatgaacagtattcattctcctttttcaatgatatgctgtagaaaatattccttgaagatgtgagatttaaaaatttttccctttcaatgttggtttaattgaatttcctaacttgggtttttttgattgatagcccagtgataaatcctaatactagacaaaatttgtcttctctttttcaaccagagcccaaatataatggcctggaataaaggggaaccttactgccttctctttga

SEQ ID NO: 2527 - DNA, 254 bp, Homo sapiens
catgtggaccatgaacagtattcattctcctttttcaatgatatgctgtagaaaatattccttgaagatgtgagatttaaaaatttttccctttcaatgttggtttaattgaatttcctaacttgggtttttttgattgatagcccagtgataaatcctaatactagacaaaatttgtcttctctttttcaaccagagcccaaatataatggcctggaataaaggggaaccttactgccttctctttgaggaaa

SEQ ID NO: 2528 - DNA, 237 bp, Homo sapiens
atttccccgatgtcccctgcgggcgcgggcagccacccaagcctgctggctgcggccccctctcggccaggcattggctcagcccgctgagtggggggtcgtgggccagtccccgaggagctgggcccctgcacaggcacacagggcccggccacacccagcggccccccgcacagccacccgtggggtgctgcccttatgcccggcgccgggcaccaactccatgtttggtgtttg

SEQ ID NO: 2529 - DNA, 209 bp, Homo sapiens
gtttgcctgcaatggtactgtaattgagcatccggaatatggagaagtaattcagctacagggtgaccaacgcaagaacatatgccagttcctcgtagagattggactggctaaggacgatcagctgaaggttcatgggttttaagtgcttgtggctcactgaagcttaagtgaggatttccttgcaatgagtagaatttcccttctct

SEQ ID NO: 2530 - DNA, 201 bp, Homo sapiens
ttatacctggacattttagatgtttatcaaaggtcttttatggggaagaaagtaaatgtatgaaataataaatgtgtgacatttatagggaatgttggctctgaacaaacttttgaaaacttggttgacaaaattttggatcaactgaaaaaagcatgacttttgaaatctctgaatgccttggttctcagtattatcatt

SEQ ID NO: 2531 - DNA, 89 bp, Homo sapiens
ttcagtgttgctttcctcttgatcagcgtgtctgaatgacagtcaggttcaggtgtgctgacacagaatgctcacaggctcacttgccg

SEQ ID NO: 2532 - DNA, 220 bp, Homo sapiens
ttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctc

SEQ ID NO: 2533 - DNA, 158 bp, Homo sapiens
ggagtggcttttctggaaacaacacaagacaacagaaaacaggtgtacacatatctctcattctcttaagccaagaagtgtgcttccctagctgaagtgtagatggtcgtgtaggggtgggtggaaaatcatgtggcatacaggtgtgggtgtaatat

SEQ ID NO: 2534 - DNA, 151 bp, Homo sapiens
ggagtggcttttctggaaacaacacaagacaacagaaaacaggtgtacacatatctctcattctcttaagccaagaagtgtgcttccctagctgaagtgtagatggtcgtgtaggggtgggtggaaaatcatgtggcatacaggtgtgggt

SEQ ID NO: 2535 - DNA, 222 bp, Homo sapiens
agggtcaaactacataaatgccagckatattgatggtttcaaagaacmmaggaaatacattgctgcacaaggtcccagggatgaractgttgatgatttctggaggtgattttggkgawcwkaaagccttwgttattktcatggtcactcgatgtkaagaaggaaacaggaacaagtgtgcagaatactggccgtcaatggaagagggcactcgggcttttg

SEQ ID NO: 2536 - DNA, 263 bp, Homo sapiens
gtttgccaagctgaagctacaggttgtgaaataatttttaacttttggaatcatactgcctactgttactctaaatagaaatatagggttttttttaatgtgaatttttgcctatctttaaacatttcaatgtcagcctttgttaaccttaaatacactgaattgaatctacaaaagtgaaccatctcagacctttactgatactacaacttttgttttctgatggccaaaataccaaatgcctgttgtatttatggattaaa

SEQ ID NO: 2537 - DNA, 266 bp, Homo sapiens
ctctatgctctgtaaggtgattatttgtatatagcaacatggcccagtgatattatatagtttcccaatggagaggttattgagtaacctttgcattagtttaaacactaccagaagaatgctgagccaactataaacactcaattttgtatgttttccaaattggtacttattactgcttttgatactgtattacgtgccaatagtttcccaatcacatagcaggcaagagatattttgtactttctgatccactgtaatattta

SEQ ID NO: 2538 - DNA, 246 bp, Homo sapiens
tgttaatccctaaaaaaggctatgcaggtaataattctggaaaacttatttaaaacattttccaagggttggtgggtgttcaaaaacacaccggagaagaaagagcttttgagaacaagaaagaaacgaagaaaaaaaagagaaagaaaaaaaaaaggggggggggaataattcggggaagaagagacttttaaaagggacaagaggtaaaaaggggggaaagagaggaaacgggtgtggacttgg

SEQ ID NO: 2539 - DNA, 173 bp, Homo sapiens
agaagccccacataaagaaacctcttaatgcattcatgttgtatatgaaggaaatgagagcaaaggtcgtagctgagtgcacgttgaaagaaagcgcgggcatcaaccagatccttgggcggaggtggcatgcactgtccagagaagagcaagcgaaatactacgagctggcc

SEQ ID NO: 2540 - DNA, 215 bp, Homo sapiens
tattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtaccctcgttccgaa

SEQ ID NO: 2541 - DNA, 298 bp, Homo sapiens
gttttgcatattgttagcatttacaaatatttttgctttagtatgaggaaagtaaggatgggcaaagaagtgatcaaaatagctattgctacaacattttcgaaaacaaagttggggctgtatttctttaaaaagataagcctctaaaaatgcttggcaaaaaaaatatagtgttaaaataggccagtgatattaatgagaaaatgaaagtatgtatcaggaataaagtgatattgcataggagtattgtatttttatgaattttatgccagttgtttacatgtaccctcgttccgaa

SEQ ID NO: 2542 - DNA, 203 bp, Homo sapiens
gcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctg

SEQ ID NO: 2543 - DNA, 145 bp, Homo sapiens
  misc_feature (65)..(65): n is a, c, g, or t
tatggctttttatgcatccttcatcgagggcattgaagttgcatggactgataaaagttgatgcnaaacaagaaagaaacaaacaaaaaaaaaaaaaccagcaaaatgtttacccaaaaactcaaacaaatgagcagtgcctgtt

SEQ ID NO: 2544 - DNA, 80 bp, Homo sapiens
aggtccaactttgcacccgcgttcttggtacctgagaccaccgacatcctcaggttcctgaccgtgcggccttctaccca

SEQ ID NO: 2545 - DNA, 214 bp, Homo sapiens
  misc_feature (29)..(29): n is a, c, g, or t
  misc_feature (66)..(66): n is a, c, g, or t
  misc_feature (96)..(96): n is a, c, g, or t
aggatgtcctttcccgggagacaagtcgngaaagcctggctggactgcctcagccccgcgcgcctnctggactcagggttccccgtcctgagctcngggagatgtcagagtcacactgccgcccggtctgccacgcagaggtccaactttgcacccgcgttcttggtacctgagaccaccgacatcctcaggttcctgaccgtgcggccttcta

SEQ ID NO: 2546 - DNA, 283 bp, Homo sapiens
cccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactccctgaccctcacctggcacccccctgctgctgcccaagccgctgggcctttttaattgccaaactgctctcttcatcagctcagcacatgctttaagaaa

SEQ ID NO: 2547 - DNA, 173 bp, Homo sapiens
atttactatgtatgtttcacttacaatttgtagggaaaaaaagtcttcaagggaacactaagattaaatgacctagcgttcaaatatgcttccttatgagattcacaatttacctgtgtgaaattaacgttctaagagacctaaaaatgttctccccaataagaactcatact

SEQ ID NO: 2548 - DNA, 208 bp, Homo sapiens
aagtgatacctgcattttttccccaggtaatcttaatttactatgtatgtttcacttacaatttgtagggaaaaaaagtcttcaagggaacactaagattaaatgacctagcgttcaaatatgcttccttatgagattcacaatttacctgtgtgaaattaacgttctaagagacctaaaaatgttctccccaataagaactcatact

SEQ ID NO: 2549 - DNA, 176 bp, Homo sapiens
gaactgatagttactgttgtgacctgaagttcaccattaaaagggattacccaagcaaaatcatggaatggttataaaagtgattgttggcacatcctatgcaatatatctaaattgaataatggtaccagataaaattatagatgggaatgaagcttgtgtatccattatcatgt

SEQ ID NO: 2550 - DNA, 68 bp, Homo sapiens
gaaggtggccgtgtgtgacatcccgccccgcggcctcaagatgtcctccaccttcatcgggaacagca

SEQ ID NO: 2551 - DNA, 291 bp, Homo sapiens
gtggatccccaacaacgtgaaggtggccgtgtgtgacatcccgccccgcggcctcaagatgtcctccaccttcatcgggaacagcacggccatccaggagctgttcaagcgcatctccgagcagttcacggccatgttccggcgcaaggccttcctgcactggtacacgggcgagggcatggacgagatggagttcaccgaggccgagagcaacatgaacgacctggtgtccgagtaccagcagtaccaggacgccacggccgaggaagagggcgagatgtacgaagacga

SEQ ID NO: 2552 - DNA, 191 bp, Homo sapiens
gattcaactgcccacggattcaagccaaaccctctggaagcggaacccagttcctccaagtgacacccggaggaactggtgccagatgcctccgacgcccccccatagaccatgggcagggacagcgaacgggttcccagaagtcccccgctttctttgccccccctacgggccctgttcaagggccatgg

SEQ ID NO: 2553 - DNA, 278 bp, Homo sapiens
cgtggctggcatcattgtcactgatgtcattgccactctgctccttgctttgggagtcttctgctttgctggacatgagactggaaggctgtctggggctgccgacacacaagctctgttgaggaatgaccaggtctatcagcccctccgagatcgagatgatgctcagtacagccaccttggaggaaactgggctcggaacaagtgaacctgagactggtggcttctagaagcagccattaccaactgtaccttcccttcttgctcagccaataaat

SEQ ID NO: 2554 - DNA, 217 bp, Homo sapiens
atcaccaccattctgctgttcagtgtctcttgagagagcctctttgcatgttttccagaatctgtgtgtgtttttcctttcttctcctttgttctttttgctcaaaggtgtgaccagtcattgccccctctggggctttcattctccaggagaaacatcccagaaccagcactgtttagcctgatacctttctaatgtccatgtcaattttcaataa

SEQ ID NO: 2555 - DNA, 208 bp, Homo sapiens
caagggacgtgggacagttcgtactgtgactaaaacagtttccaatgactctttctttaacttttttgcccctcctgaagttcctgagagtggagatctggatgatgatgctgaagctatccttgctgcagacttcgaaattggtcactttttacgtgagcgtataatcccaagatcagtgttatattttactggagaagctattgaa

SEQ ID NO: 2556 - DNA, 177 bp, Homo sapiens
  misc_feature (140)..(140): n is a, c, g, or t
ctggaatctgtcctcgtgtccacctggccttcgctcctccagcagtgcctgcctgcccccgcttcgctggggtctccacgggtgaggctggggaacgccacctcttcctcttccctgacttctccccaaccacttagtancaacgctaccccaggggctaatgactgcacactgggc

SEQ ID NO: 2557 - DNA, 298 bp, Homo sapiens
  misc_feature (230)..(230): n is a, c, g, or t
gttcttcctgttctgtgactgtgtatagtgccaccacagcttatggcatctcattgaggacaaagaaaactgcacaataaaaccaagcctctggaatctgtcctcgtgtccacctggccttcgctcctccagcagtgcctgcctgcccccgcttcgctggggtctccacgggtgaggctggggaacgccacctcttcctcttccctgacttctccccaaccacttagtancaacgctaccccaggggctaatgactgcacactgggcttcttttcagaatgaccctaacaagacacat

SEQ ID NO: 2558 - DNA, 300 bp, Homo sapiens
ttggcagacaggcttttttagttaccgtaaccagatcttaagattaattaaaaactacataaagtgcttttaggtccttagagatacatgatataaataagcggcttatgatcaagaacgataaatacataggtaaaaatagctctagcaaagatgaccttatggctctgagatgggcaggcagggcaattcttccccattacattcttagtcatcttattcatacctatttttaaatggagtccacagactaaaggtcatgttccgagactgaagctttcaaatgaccctagttccaat

SEQ ID NO: 2559 - DNA, 199 bp, Homo sapiens
aacaagacttagaaggagggcccaggcactttctgtttgaacccctgtcatgatcacagtgtcagagacgcgtcctctttcttggggaagttgaggagtgcccttcagagccagtagcaggcaggggtgggtaggcaccctccttcctgtttttatctaataaaatgctaacctgccctgagtttccattactgtgggt

SEQ ID NO: 2560 - DNA, 275 bp, Homo sapiens
tctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattctca

SEQ ID NO: 2561 - DNA, 273 bp, Homo sapiens
tctgcccacgtgctcaacgtgcagtcgtagcccggccctctccagccggctgccctctctgcctccctctttctgttcctcctgcccagggcacccccttagtgcctccagcttctgcctacctcaccccccctttcgtgcccctggcctgagcctcctgctggcctggccctggccgcccacctgggttcatctgacactgccttccctctttgccctgtggtactgctgtctgccaggtctgtgctgccttgggcatggaataaacattct

SEQ ID NO: 2562 - DNA, 131 bp, Homo sapiens
gatgcggaaggaacgcgactggcctgtccccggccgcggccgccagtcctctgtgttctccatcagccgctgcttgctggcatctgggaccagcggtcggagcggctgtccattctgctgcggggcgctgt

SEQ ID NO: 2563 - DNA, 217 bp, Homo sapiens
  misc_feature (102)..(102): n is a, c, g, or t
  misc_feature (169)..(169): n is a, c, g, or t
ctgtgttctccatcagccgctgcttgctggcatctgggaccagcggtcggagcggctgtccattctgctgcggggcgctgtcagcgggcgggggcgccccanagggccgggccgtcttgttgagggagacgctgggtgcacaggtgtaccgcggagggtccgcggcggnggcggaggccttctgcggtttgctctgaaccggctgggccctgctgag

SEQ ID NO: 2564 - DNA, 256 bp, Homo sapiens
  misc_feature (147)..(147): n is a, c, g, or t
  misc_feature (214)..(214): n is a, c, g, or t
ggaaggaacgcgactggcctgtccccggccgcggccgccagtcctctgtgttctccatcagccgctgcttgctggcatctgggaccagcggtcggagcggctgtccattctgctgcggggcgctgtcagcgggcgggggcgccccanagggccgggccgtcttgttgagggagacgctgggtgcacaggtgtaccgcggagggtccgcggcggnggcggaggccttctgcggtttgctctgaaccggctgggccct

SEQ ID NO: 2565 - DNA, 270 bp, Homo sapiens
tctaccgcgggtttatactggatgaaaaactcatgccaacaccaaaaagcaaactccagggggttccccgtacccaatagggcccatggtgagtcggcccacaattaacttgcccttctattacaaccgtctagtcttgcgaaaacccctgcggttacccaccctaaatggccttgcagaacttcccccttttgcccgattgccgtaacatccaaacaggcccctaccgatctgcccttccaacaaatgggcaacccttaatgggcgaat

SEQ ID NO: 2566 - DNA, 89 bp, Homo sapiens
tcttcctgccaagaaagaatgggggattccattccttgagggattatgccaaattaacaagaatatctcgggggaaacacaggataaat

SEQ ID NO: 2567 - DNA, 294 bp, Homo sapiens
gaaattttgaataacctatatacacaaataaaaacacgggcaggccgcctcttagaagaattccctccaagggggcccaaactttacgcggtaccccaccttttctttggtaaaaagaggggccccctattagaggagccggcatttttaacgttaagggactggggccggactattttataaagtctgtggtaactgggaaaaaactgcccaaccttgggaaacctttcgtgaaaggaaaacttttacttttggggggtgagcgcaataatatgtggccacacacttccttcc

SEQ ID NO: 2568 - DNA, 247 bp, Homo sapiens
ttgggccccatttcagaaaatctcagactctaaaccaccagtgattgccctagcatgctccagaattgtcccgcacttagtcactctggttcgattactgttgcgaaaccagtcccccattatgacaatacccagcggggtctttggtaacatggccgagatgaatcaaaacgggcccttcgggcacgttaaacctgctactaaacaggatgggtaaaacactccaggcaaacaccagcgaaagatt

SEQ ID NO: 2569 - DNA, 283 bp, Homo sapiens
gaagacctggttttgatgctgcctcagaacatttgggataacctatatagcaggtatggtggaggaccagctgtcaaccatctgtacatttgtcatacttgccaaattgaggcggagaaaattgaaaaaagaagaaaaactgaattggaaatttttattcggcttaacagagcgttccaaaaagaggactctccagctactttttattgcatcagtatgcagtggtttagagaatgggaagttttgtgaagggtaaagatggagatcctccaggtcctattga

SEQ ID NO: 2570 - DNA, 185 bp, Homo sapiens
actctggacatcagcagcacgcggggcttcccattcagtcctgagagggggggaagtacggcagccacctctcacaggtggctggtgcttccaaggaggtcatgccgggcacacgccaacccgtggtgtgcgcagtcacgccccgaggacaagaaaaaacggccttccactgttggctgagctgc

SEQ ID NO: 2571 - DNA, 160 bp, Homo sapiens
aattgatttctatttgccattctccaaaagacaaaaaaagttggtttttttttttttcggtcttttgtttgtttgtttgttttttaaaaaatagggtcttgctttgttgcccaaactggaggtcagtggcttttcacagctgcagttatagcctactgca

SEQ ID NO: 2572 - DNA, 192 bp, Homo sapiens
gtatggtctaacctttaccataggactttattctttaaactccattacatgtaagggccgttatattttgcagcctccacattaagaatacttggtatgctttctccaaagcggtgagcttatatacaagactggcatattaaaattttccgctacacttactccaagaaagctttggaatagcagtcttat

SEQ ID NO: 2573 - DNA, 102 bp, Homo sapiens
acacacacacacttagccaggcatggtggtgcatgcctgtaatcccagctacttcagattctgaggcaggaagaatcacttgccccagaggcagagtttgca

SEQ ID NO: 2574 - DNA, 136 bp, Homo sapiens
aagagtgccatacccaggcatgaacaaccgggaggtgctggagcaggtggagcgaggctacaggatgccctgcccgcaggactgccccatctctctgcatgagctcatgatccactgctggaaaaaggaccctgaa

SEQ ID NO: 2575 - DNA, 209 bp, Homo sapiens
  misc_feature (74)..(74): n is a, c, g, or t
aattctgtatattagattactcttaaacgaaaaaccagctgccgcttttatgtacacatattacatacgagtangcagcagactttaaaaataaaaaaacctaggcatgttgatgttgcaaaatgctgtataaagctgaaactggtcattcagtgccattgtagttgacatgaagcgattgtaaaactgtctccgatttttctctggtt

SEQ ID NO: 2576 - DNA, 184 bp, Homo sapiens
  misc_feature (120)..(120): n is a, c, g, or t
tccagtttagccatggctagggtcctggaactataataagcaagggtccagactggtggggtttcctcctttctcctgtggcttggaacctcttgggtttgaaaagctgggcgcctaccnaaaccctttttttccctataatccccggaattggggggcaacagaacggttggggaatctcctg

SEQ ID NO: 2577 - skipped

SEQ ID NO: 2578 - DNA, 240 bp, Homo sapiens
atctgagcatttagcctaaggcagttaactcctacaaagtgtccatgaaaccaatacatctgaaaaggcctatgctccaatgcagatctggaatccatgagcagttttggagtaccgatcagattaatgaagatactttaacaacctgccacctaatctggtggtaataggtaacgttacccctgaatttggcggaattggccaaggaaaataaagatggcaagcttacatcaaatttta

SEQ ID NO: 2579 - DNA, 292 bp, Homo sapiens
tgactttcaattcctggccgttggtctgttgttctcaagaattccaaaagaccctctttggtggtgggaccaacacatatgtaaggcaccgtgcaaccaggtttaatcgaagtgaccaagtgagggcatcacgaaagctttcttcacccccataatgggagggcagcacacaatagctgtcagacacctattggtgacgtcaccctgctacggacgggcaaaaaattcgcacacaatcgaagaacccacctcctgatagaagtttcccagacgctcgttagaatcgtgccca

SEQ ID NO: 2580 - DNA, 273 bp, Homo sapiens
gaccgactgggtatctagcttactgttttaacatcattgttgaaaccagaccctgtagtccagtggtgctgccctgttgtgcaaactgctcctttttctcgtgtttttgtaaagagcttccatctgggctggacccagttcttgcacatacaagacaccgctgcagtcagctaggacctttccgccatgtattctattctgtagtaaagcatttccatcaacaatgcctaattgtatctgttatttttggtttaacacacactgattcatact

SEQ ID NO: 2581 - DNA, 225 bp, Homo sapiens
gcaactgagtgactctcacctaccaccgactggggagtggtaaaagcacttgacggatgcctggcaacttaagacctgctggaagaggggcacaatgcccccggagcgagaaaaccctgaatctcatttcatcccttcaatccgtatgtttcacaaccccaactttcactggcagttacttaaagtcctctcctgctctcttccaagtgttctaggcaaaccctc

SEQ ID NO: 2582 - DNA, 251 bp, Homo sapiens
tgtgaatgagcaaagattctgtcttggtgacacagtagttcatatcaaatgaaatgtttaattgaaaccttagaaactgtaacaaggtatgaggcacgataaagaagaaagagaatgaaagaattaaaaggcttccttctcagtctcaaattcctactgccttaagaatttttaaattaaaaccagttcttcataagcaatcagtggctgagaatttgaggttataacctggcatggatatatgtgacaca

SEQ ID NO: 2583 - DNA, 147 bp, Homo sapiens
cttgtgagccctgggcttaggagtcaccatggcaactgaagagttcatcatccgcatccccccataccactatatccatgtgctggaccagaacagcaacgtgtcccgtgtgggaggtcgggccaaagacctacatccggcaggaca

SEQ ID NO: 2584 - DNA, 106 bp, Homo sapiens
tgcgcgcctctttcttgtatcctcaccccgatttgttacgccgctacgccgccgcttctatattccttttcatgcaccgcctggcgtcgccttttgcgcgccgacg

SEQ ID NO: 2585 - DNA, 115 bp, Homo sapiens
atctctgcaaaacaagtgctttttccagaataaccaagatttactgagtccaagtttttaataacaagaaataaacaacctttgtgaaaataatcatgggattggtatgggtttt

SEQ ID NO: 2586 - DNA, 83 bp, Homo sapiens
attattttcttcttataaccatggcatcatatatacctttgtttccacaactctattttcatatgttacgtcaaagaagaaag

SEQ ID NO: 2587 - DNA, 262 bp, Homo sapiens
aatattacttcatgttcctcctttctaaattactaacttttgttatactggtactgatattttgtcccatttcactctcttctcatacgtgagtacttaagaatatgtacattcttgctctgcactgtatgtgtgagctatatggtattgtgtaaattttttttggaaggacaatggaaattcttgagaaacagtttgtttaaacgaaatatatttcaaactcatttgtgaataaattgatcatccatctcaatatgtttga

SEQ ID NO: 2588 - DNA, 252 bp, Homo sapiens
aacagcatgattgggttaggaatttgcataggatgagttcagtggtgagacttttgaaactacacacatctaccttgttttagtcctattttcaaaattttggcattgtgagattttatttactgtgtgaacctaaagttactgtttaagtacatgccacgcaactctgtgttattaagaagcactgtctcagaagctgtgtgtaaatttaatattaaggcactaaagaccaagcataggtacatgcctgta

SEQ ID NO: 2589 - DNA, 167 bp, Homo sapiens
gattgttttcatcctgatactgtagttcactgtagaaatgtggctgctgaaactcatttgattgtcatttttatctatcctatgttaaatggtttgtttttacaaaataataccttattttaattgaaacgtttatgcttttgccaacacatcttgtaacttaatat

SEQ ID NO: 2590 - DNA, 262 bp, Homo sapiens
ctctctctgcaggagtgctaatcactgtggcttctgttaagaattcccaacttgatctctctcctgatgctgctggaaggatggaaccgtcatctcctccatctgaatcactgacaggcattcttagatttttaaatcaggatgctgaaaactatctttgtcccttacctccaccttctttttgtacctcccagacccaggcccacctctcacgtttataaggtctaggtcaagaatacaaatggagccctacataccatta

SEQ ID NO: 2591 - DNA, 168 bp, Homo sapiens
gatattttgaattgtatcttgcgggtccctgtgttgaagtgataaacatttgcatcttattaaaactgctttcacacttgtagaccccacaacttacaacaattaattggccgttgttttacaacggctgactgggaaacccttgccgtccccaactttattgcttgt

SEQ ID NO: 2592 - DNA, 243 bp, Homo sapiens
tggcccgcgtgattgtggcatttaaggagcagtggcccatgtgactgtggcattttcggcacttttcattactttctgcttgaccggaagttgaggcttagctatgtttccatcttcagtttctgaagactagttatatattccttactagaaatatattcataatatataaaagaaatatatctgtgattttaaaattttgctaccaaagaatgcatgttctgtgtgccctgaaaatgttac

SEQ ID NO: 2593 - DNA, 264 bp, Homo sapiens
catcagaaagattcccaggctggctacttcgggatgacccttgcattttttattgaaatcatttctgaatcttttttccccactagcttttaagacataggaactatatcttgttcagctttgcacttccaattataaaaaaatgcctggcgtgtgttaggcactcagaaaatgtttgaactgaaccaatggtgtgtgtgtctctgcacactctaagttagtgtaaatcagaacagcttgttgttgctgcttgttttgatcaag

SEQ ID NO: 2594 - DNA, 263 bp, Homo sapiens
tacaacagtttaggtttaagatgaccaatgacaatgaccacctttgcagaaagtaaactgattgaataaataaatctccgttttcttcaatttatttcagtgtaatgaaaaagttgcttagtatttatgaggaaattcttcttcctggcaggtagcttaaagagtggggtatatagagccacaacacatgtttattttgcttggctgcagttgaaaaaatagaaattagtgccctttttgtgacctctcattccaagattgtc

SEQ ID NO: 2595 - DNA, 121 bp, Homo sapiens
aaaacaatcggaacacaagtcagtaattagtagacacagcagatcgtaccaacggccggctaaagggcccgacactaaaataccatcgaccacaccacgagccaaacacacacaacgggca

SEQ ID NO: 2596 - DNA, 195 bp, Homo sapiens
cccctagaaatctcctggaagagaggaaatcagatcaactggggctgcctcagaccttgcagcaggaattctccctgatcaatgtgcaaatccggaatgtcaatgtggagatggatgcggcagacaggagctgcacagtgtctgtgcactgcagcaaccatcgtgtcaagatgctggtgaagttccctgcacagt

SEQ ID NO: 2597 - DNA, 283 bp, Homo sapiens
tgtgtaccttggagtgacttcctttctcaacttccactgcagtgtgtgtgccttctgctctgagagctgccttgtgacccgtgtgatagaaagcagggagtgagggtccccgcggacctggcccttccctccttcctcccccagaaagaggagttagagcaggggtgcgagagccgttcgctgtgggtttgtctttgaacaaacattaaggtgtcttgtttttgttctgggctgggggttggctgtagtcttaggtaactgaaagttcctactctcccttaag

SEQ ID NO: 2598 - DNA, 223 bp, Homo sapiens
ctgagggttggcatgaatgcttttctttttcacgtgtaacattaggttcagacatatatgtgtgcagtgcattgctgtaatgtgtgcacatggtaagaacacatatgtctcaataccatgctgtatcgctcaatagcctgacagatgtatatgggtgaattcattcattgccctctctggtgattagtagcactttgaaaatgatgtcgtaatttggcaaact

SEQ ID NO: 2599 - DNA, 288 bp, Homo sapiens
tctgcctctactaaatggctccaaacagctgcaatttcacaaccaaagttttttacttgaaacagcatgttactccttgctaatctaattgagtgtgtattaatcggctacactggtcacacatttgattgggtaagacctaaagtaggctctgcttaacagtgagtccgttcatgtgacctataaaatctctctcagagactcctttccagtccatctttgtcagctgtcttgtctagagctttcaactagctcatagcctccagataacaaggtcctcgtgccgaa

SEQ ID NO: 2600 - DNA, 163 bp, Homo sapiens
attgagtgtgtattaatcggctacactggtcacacatttgattgggtaagacctaaagtaggctctgcttaacagtgagtccgttcatgtgacctataaaatctctctcagagactcctttccagtccatctttgtcagctgtcttgtctagagctttcaact

SEQ ID NO: 2601 - DNA, 62 bp, Homo sapiens
aagactgttgaccacttgaatttctttggtgttagtggattaacctaaccattactctgaga

SEQ ID NO: 2602 - DNA, 244 bp, Homo sapiens
ggtctttcaaacacatctgcacataagtcacacatttcaataaagcattttcaagactgttgaccacttgaatttctttggtgttagtggattaacctaaccattactctgagattttatatctctaatccagtattttttttctttttatgctaaacatgggagatcctggttttgtgtgaatgcattattttggatgtgagaaataaatgccaattatatgtactttcccttttctgcacaa

SEQ ID NO: 2603 - DNA, 281 bp, Homo sapiens
gatgcttcagtcaacttctcagagttttctaagaagtgctcagagaggtggaagaccatgtctgctaaagagaaaggaaaatttgaagatatggcaaaagcggacaaggcccgttatgaaagagaaatgaaaacctatatccctcccaaaggggagacaaaaaagaagttcaaggatcccaatgcacccaagaggcctccttcggccttcttcctcttctgctctgagtatcgcccaaaaatcaaaggagaacatcctggcctgtccattggtgatgttgc

SEQ ID NO: 2604 - DNA, 261 bp, Homo sapiens
ctgccagttgcaaatttgataggatagttagtgaggattattaacctctgagcagtgatatagcataataaagccccgggcattattattattatttcttttgttacatctattacaagtttagaaaaaacaaagcaattgtcaaaaaaagttagaactattacaacccctgtttcctggtacttatcaaatacttagtatcatggggggttgggaaatgaaaagtaggagaaaagtgagattttactaagacctggttta

SEQ ID NO: 2605 - DNA, 261 bp, Homo sapiens; identical to SEQ ID NO: 2604

SEQ ID NO: 2606 - DNA, 33 bp, Homo sapiens
ggatggacgatgaccgatgacggaagctgagtc

SEQ ID NO: 2607 - DNA, 297 bp, Homo sapiens
tggacgatgaccgatgacggaagctgagtcagctacgggcaagcgggcagctgaagatgatgaggatgacgatgtcgataccaagaagcagaagaccgacgaggatgactagacagcaaaaaaggaaaagttaaactaaaaaaaaaaaaggccgccgtgacctattcaccctccaattcccgtctcagaatctaaacgtggtcaccttcgagtacgagaggcccgcccgcccaccgtgggcagttgccacccgcagatgacacgcgctctccaccagccaagccaaaccatgagaat

SEQ ID NO: 2608 - DNA, 237 bp, Homo sapiens
tgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaaccc

SEQ ID NO: 2609 - DNA, 244 bp, Homo sapiens
gtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaaga

SEQ ID NO: 2610 - DNA, 120 bp, Homo sapiens
cacagtgaagcatctcgaagagattgtagagaagctaaaaggagaacttgaaagttcggaccaggtgagggagcacacgttgcatttggaggcagagctggaaaagcacatggcggccgc

SEQ ID NO: 2611 - DNA, 33 bp, Homo sapiens
ttttaaattctgtgaaagtggcttgattaaaag

SEQ ID NO: 2612 - DNA, 179 bp, Homo sapiens
tgagggaggtttacagcactacaggtcttgagttaagaaggaaagaggaaaaagaaaaaacccccataccccgatttaaaaaaaaaaaaaaccgatccttagtctttagaagttccatttaaacccatagggaaccttttccccttaatcctcatggttaagcctgtacccagttccag

SEQ ID NO: 2613 - DNA, 263 bp, Homo sapiens
gccttgcccagtgggtagacagctactacacaagcctttgacccccatgctgcttcctgagagtctttttttgcactgttgaaattgggcttggcactcaagtcaaagatgaacatcggaataacaaacattgtcctctccagaaagtcctttctttctccatactgtagtcctattgagaagacatttcgtctctgagaaaaaaaggatggaactatgggttctcttcgcaaagccaaaggatagtgtttaacaagccagct

SEQ ID NO: 2614 - DNA, 196 bp, Homo sapiens
tttggcttcatttaagctgtatacttagtcatatatctttcattagttctatggatatgagcagatccctttactggagcccagtatgtgctgtgtgagttagaagtcattcttgctgagaaggtgaataggtagggatttgccttgttttgtaagtctacaatttgccaagagtaaataacactggaccagctgt

SEQ ID NO: 2615 - DNA, 191 bp, Homo sapiens
aagctgtcttcactaagtatcccctagtctctatatatgtggttagtagtcatggaaatgacacataaagtacgccagaagtttgatggaacgtgttagaaactgttttgtgcttttatggatgtcatacttgacaatacatgtgtaagttactaatatatgaattgatgctaaatatatcttacatttga

SEQ ID NO: 2616 - DNA, 166 bp, Homo sapiens
tgtcgagataagagagcagatgttggagaattcttctagattttcagaacttgaagactattttctaatttctatttttttttctatttcaatgtatttaaactctagacacagtttttatcctggattaacttagataacttttgtagcagtggttatattgctt

SEQ ID NO: 2617 - DNA, 143 bp, Homo sapiens
aactttgtcaaatttgtggagttaggtggaagccagattttaaaagttgccaaccaggatatttaacaggtacagttacccgtttcaatgttatttttaagaagggagatgttggcacctttgaattctacatcctgtttctc

SEQ ID NO: 2618 - DNA, 36 bp, Homo sapiens
tcttgatgggccttttgtcccaggacttccacattt

SEQ ID NO: 2619 - DNA, 151 bp, Homo sapiens
ttctcattgaatgcacctattaatcgttttagttgctattcatattctcattcgttttttaaaaatgatatattcctgatttattcttccattgagaaaaaatgttcagttacttgtaactactgagcagaattaatcaatccctttataa

SEQ ID NO: 2620 - DNA, 273 bp, Homo sapiens
  misc_feature (153)..(153): n is a, c, g, or t
gaaaagcgcccatgtaacacaaactgccattcaacaggtatttcccttactacctaaggaattgtaccattgctcagaattgtaggatttactatgttgaaactacaggagagccgggcgcatggtcaccctgtatccagcctttggaggcangcggcaatcacagtcagaatgaacatctgctactgtgaaccgctcataaatcaaaatacactgtgctgcctgatcatatcgagtagcgaatgtgacgaggatcagacatgctgccacgga

SEQ ID NO: 2621 - DNA, 36 bp, Homo sapiens
actgctgcatgactatcatctttgagtgaagagaaa

SEQ ID NO: 2622 - DNA, 268 bp, Homo sapiens
atcctttagtgcctcagaagatgaaggccacagggaataccaagccaatgactctgactcggacgggcctatcttgtacaccgatgatgaggacgaagacgaagatgaggatggcagtggagaaagtgctttggcaagtaaaatacgccggagggatactcttgctatcaaacttggcaacagaccatctaagaaagaactagaggacaaaaacatcttgcagcgtacatctgaagaagagaggcaggaaatccgacaacaaattgga

SEQ ID NO: 2623 - DNA, 126 bp, Homo sapiens
aaaatagcttttgaggattaacgcaaaaataaaataactccttgtaccaggtccagaaattggcctattaaaacctgaatttgggcagtattttataatgggccatttggcttgtgggttacaaaa

SEQ ID NO: 2624 - DNA, 137 bp, Homo sapiens
aggccgggactgatatgcaggaatcccagcctactgtgggcttggatgatgaaactccacaactactaggamcctactcacaaaaaaaagtctaagaaaaaaaagaagaaaaagtccaatcaccaggaatttgaggc

SEQ ID NO: 2625 - DNA, 231 bp, Homo sapiens
cacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggggacttatggaaaagctgacacctaagtttaccaacatgtta

SEQ ID NO: 2626 - DNA, 206 bp, Homo sapiens
acatcgatgtcagtgacacttgaacaatgctcaatcttgagagatgagcaccagttacacaaggacttctttatccgagcgctggattgcatgagaagagaaggatgccgcatagagaatgtactgaagaatatcaaatgcagaaagtatgctttcaacatgctacagctgatggctttccccaagtactacagacctccagaggg

SEQ ID NO: 2627 - DNA, 156 bp, Homo sapiens
  misc_feature (54)..(54): n is a, c, g, or t
ccccattcaggtcatggtagaatctactccttggtagtcacttgtcatttttanagaaatgatgacaatcctcttggcatcaccccaccccacattctccccgatggtcctctcctgaattctggattttgtcctacaagtctgtgccatttataa

SEQ ID NO: 2628 - DNA, 90 bp, Homo sapiens
ggcaacacctcggccctgggcaggggctacattggaaaaatcttcggcatggggcgaaagaaggtcacagtgaacaaggggttggcgaaa

SEQ ID NO: 2629 - DNA, 299 bp, Homo sapiens
tcctctccgaggtgaaatctgagaagaaatccttggatctcttttcttaaaaaaaaaaaaaaaaaaaaaacttctgaaacccagggggttttggcttggcggccccctatccccaaaaaaaaaaagtttttcaactcccgggaaaaccaggggggttttggcctgggctccggctccagggggggagggggcaacacctcggccctgggcaggggctacattggaaaaatcttcggcatggggcgaaagaaggtcacagtgaacaaggggttggcgaaagggggattggctattgaatt

SEQ ID NO: 2630 - DNA, 48 bp, Homo sapiens
aatgctgggaagtcctaaccacatcaagaatgcctcagatcagtgacc

SEQ ID NO: 2631 - DNA, 181 bp, Homo sapiens
gcaagaccctcagtacaaaataaacgtcagaaacaaaaacaattagcttggggcattatggcacacacctgttatccgagccacttggaagctgagggggagatcggttgagccaggagttcgaagtgaggactctgattgcacatggatccaggtgcgtaccaatggactttttcaaata

SEQ ID NO: 2632 - DNA, 180 bp, Homo sapiens
acagtggtgtgaagaaccccagtaaggtatttactttccactgtactcatatgtttggttgaactcttaactctatccttattggttattacttgttaattctgagtttccctttataaactttcctaaaaaaaaaaaaaaaaaaaattgggggcgcgcgcagaaaatttaacaccattg

SEQ ID NO: 2633 - DNA, 248 bp, Homo sapiens
tatgactgtgagacttttccaagggatttttttaaaaaacacattaggctttgtgcagaagtaaagaaacagtggtgtgaagaaccccagtaaggtatttactttccactgtactcatatgtttggttgaactcttaactctatccttattggttattacttgttaattctgagtttccctttataaactttcctaaaaaaaaaaaaaaaaaaaattgggggcgcgcgcagaaaatttaacaccattg

SEQ ID NO: 2634 - DNA, 169 bp, Homo sapiens
acactttcaattttatttgaggctttccacactatttaaaaggaaaatgtaagaaatttgacattcctggagttattataaccattaggaaaatgagccataacattcacctcctgatttttacccatttaagggggagaattaagtaaaacagaactggcttacaggg

SEQ ID NO: 2635 - DNA, 251 bp, Homo sapiens
tctcaagccaactgcagctggaaagtgctgcttatcctccacccccagaaaatgcatgtatcaatatgagaataaagaacgcacactttcaattttatttgaggctttccacactatttaaaaggaaaatgtaagaaatttgacattcctggagttattataaccattaggaaaatgagccataacattcacctcctgatttttacccatttaagggggagaattaagtaaaacagaactggcttacaggg

SEQ ID NO: 2636 - DNA, 189 bp, Homo sapiens
gaaaataggtatacagtggattaattaaatgcagcgaaccaatatttgtagaagggttatattttactactgtggaaaaatatttaagatagttttgccagaacagtttgtacagacgtatgcttattttaaaattttatctcttattcagtaaaaaacaacttctttgtaatcgttatgtgtgtatat

SEQ ID NO: 2637 - DNA, 243 bp, Homo sapiens
tttacaccaccctcgtggaattggcgaaaaaaactgcccgagcttgtgggaaactttttgtgggagaggaaccccttacttttcggggggggggcgcacaaatttggtgaccaacctccgccccccacagaatttcgaggccccccgaggggaccaaaataaacactcttctcagccgacacattgcggctaaaacaaacgcaccgacaaaatacctttcgcgcgcggttgagaaccattttc

SEQ ID NO: 2638 - DNA, 171 bp, Homo sapiens
atctgtgtgcgtggctatcaggagttctaggaactcagtgcaatacgggagtgacccagctacttgaccagccacgaacagcccgccagaggccctgaactggacggtacgttaatgtgaatgttatagtctttgcaaaatcccaaaggatttcatgagggtaataaacag

SEQ ID NO: 2639 - DNA, 295 bp, Homo sapiens
aacggccaggaaaagccctcatcttctctttctctcctcagtttacatcttgttggtacctttctagccttagacaaatgatcaccatgttagccttagaccaagaagctggctagtcctttctgtgaagctaatacaatggtcatttccagacaaatttaaaggaaacactaaggctgcttcaaagattatctgattcctttaaaatatatgtctatatacacagacatgctctttttttaagtgcttacattttaatagagatgaatcagttttggaatctaagctgtttgcc

SEQ ID NO: 2640 - DNA, 104 bp, Homo sapiens
  misc_feature (53)..(53): n is a, c, g, or t
aaaaatagtatttgcataaccctgaacggtgggggaagaggggtgtgctacanatgatagagggattttataccccaattatcaactccgtttttatattaatg

SEQ ID NO: 2641 - DNA, 102 bp, Homo sapiens
gactatgacccaaagaaggatcaaaacccagcagagtgcaagcagcagtgaagcaggatgtatgtggccttgaggataacctgcactggtctaccttctgct

SEQ ID NO: 2642 - DNA, 274 bp, Homo sapiens
ggtgtatcccggtatttggtgtacaaacagttggtcccattattgaagtcgcacttttatatacacacatagtacgatgtcaaccgttgttttacacaccgctggagatcgggcaaaacacgcgaacagacacggggcgaaacctcgggcagaagcgcaccccaacatcacagagggggctgaacaccaaggcgcaaaactcaaccataaagcgagattaaagacagacgagggcacaaagtaaaacctgtacacgcgccaacacgggacacaa

SEQ ID NO: 2643 - DNA, 239 bp, Homo sapiens
ggaagctcagaaaagcataaagacaaacataaagacagagacaaggaaaaacgaaaagaggaaaaggttcgagcctctggggatgcaaaaataaagaaggagaaggaaaatggcttctctagtccaccacaaattaaagatgaacctgaagatgatggctattttgttcctcctaaagaggatataaagccattaaagagacctcgagatgaggatgatgctgattataaacctaagaa

SEQ ID NO: 2644 - DNA, 86 bp, Homo sapiens
  misc_feature (55)..(55): n is a, c, g, or t
agaaactcagttacagcctccttggtgctttagcattcagctcccttcagctggnatttatataatcctgaaacggctttagtcca

SEQ ID NO: 2645 - DNA, 129 bp, Homo sapiens
agtgggctgaatattccttagggactcaattaataagtactgtcatttctaataggcatgggtttccattctgcagaatgaactaagaaaagagaaacattgctgatgcttctgagttttgaatatctc

SEQ ID NO: 2646 - DNA, 282 bp, Homo sapiens
gatatgaaagccaacctgcctaaggggggtatgaaagatgtgtatctttccaaacttttaaaacaacgtaagtctgagataagaacatatttgatggcactgtttggaaagaggtgtccttattaaaaaaaaaaaaaaaaaaaaagctatctatgtagtgggctgaatattccttagggactcaattaataagtactgtcatttctaataggcatgggtttccattctgcagaatgaactaagaaaagagaaacattgctgatgcttctgagttttgaatat

SEQ ID NO: 2647 - DNA, 242 bp, Homo sapiens
cctgggggcaggacccacagccagtgggctaagacctttaaaaaatttttttctttaatgtatgggactgaaatcaaaccatgaaagccaattattgaccttccttccttccttccttccctcccttcctccttctctccttctctcctcctctctcctctcctctcctctctttccttccttccttcctttttttctttttctctttcttctttatttcttgggtctcactctcatcaccc

SEQ ID NO: 2648 - DNA, 148 bp, Homo sapiens
aacagggagccgacttataacactagggcccggggtcccccctttttaccacacttccgactggccaaaaaccggcttacctttcggaacccttggggaaggagacacctactcctctcggggcgcggaacctacattggtacaaaat

SEQ ID NO: 2649 - DNA, 264 bp, Homo sapiens
aaaagggacgctccattcccgtatggataaaaattttgctgtttgttgttgtggcagtttttttgtttttggtctatcaagctatggaaaccaaccaagtaaatcccttctctaattttcttcatgttgaccctagaaaatccaactgaatggtatctctttggcacgttcaacttggtctcctattttcaataactgttgaaaaacatttgtgtacacttgttgactccaagaactaaaaataatgtgatttcgcctcaataa

SEQ ID NO: 2650 - DNA, 172 bp, Homo sapiens
gaaaagtgggactagacacggtgtccatatggagaggaaaaatatacatagaatatttttaacaaaatgtattcattgtataaatggaatccttctgtaactttggtaactgcatacttgttgtttggtaatgaaccagaggaggtataatactctagaattgtgtaacatt

SEQ ID NO: 2651 - DNA, 73 bp, Homo sapiens
gcagcctgaaaagcaggctagcagacaaataaacagcaagaaaacggccccattgacgactggcaataaaaat

SEQ ID NO: 2652 - DNA, 83 bp, Homo sapiens
ctggagacctttgtgaacaaagcggaatctgctctggcccagcaagccaagcatttctcagccctgcgagatgtcatcaaggc

SEQ ID NO: 2653 - DNA, 135 bp, Homo sapiens
caagagaagagtaatacgtggtcctgggggattttgaagatgttaaagggaaaagatgacagaaagaaaagtatacgagagaaacctaaagtctctgactcagacaataatgaaggttcatctttccctgctcct

SEQ ID NO: 2654 - DNA, 110 bp, Homo sapiens
tccctgctcctcctaaacaattggacatgggagatgaagtttacgatgatgtggatacctctgatttccctgtttcatcagcagagatgagtcaaggaactaattttgga

SEQ ID NO: 2655 - DNA, 209 bp, Homo sapiens
agagaagagtaatacgtggtcctgggggattttgaagatgttaaagggaaaagatgacagaaagaaaagtatacgagagaaacctaaagtctctgactcagacaataatgaaggttcatctttccctgctcctcctaaacaattggacatgggagatgaagtttacgatgatgtggatacctctgatttccctgtttcatcagcagaga

SEQ ID NO: 2656 - DNA, 96 bp, Homo sapiens
  misc_feature (56)..(56): n is a, c, g, or t
cctggaaggccacaagcttaaccactttcgcacaaaccccatgttaaccactggcnacttttccaatggccacagaaccaactcaccattggttca

SEQ ID NO: 2657 - DNA, 94 bp, Homo sapiens
  misc_feature (54)..(54): n is a, c, g, or t
tggaaggccacaagcttaaccactttcgcacaaaccccatgttaaccactggcnacttttccaatggccacagaaccaactcaccattggttca

SEQ ID NO: 2658 - DNA, 66 bp, Homo sapiens
agggatttttaccacatgaaagtcattccagtggaccctaacctccttattggtggaaggttagtg

SEQ ID NO: 2659 - DNA, 69 bp, Homo sapiens
ttttactatggatcagtcggcactcgggaacagcagcaaggaaaaaaagcaaatttcattcacatgttc

SEQ ID NO: 2660 - DNA, 198 bp, Homo sapiens
ttttactatggatcagtcggcactcgggaacagcagcaaggaaaaaaagcaaatttcattcacatgttctgggttcatacctcttctctacctaattggtcattttaaatttccagccttattccctggataagggatttttaccacatgaaagtcattccagtggaccctaacctccttattggtggaaggttagtg

SEQ ID NO: 2661 - DNA, 241 bp, Homo sapiens
tcaggagccacagccatttcttagagggtttcaaaaggacagcctttggcgccttttccttctaacctttgagtccagccctttccagttttcattcactcgaagtaactgcactcaagctgtgctcaaaatcggcaacgcatttatttacaccaagcccttcccataaaacacaactgctgaagaaaatagcagacgtttcccctctctctaactctgggtatcccacagatgcaaaagg

SEQ ID NO: 2662 - DNA, 245 bp, Homo sapiens
gtattccctgctagatattgattgttatttcaagtattaagtgtaagcttttaatggataattagtataactgtggatggcatctgattttgtttttaattctgtggattgtgtttaagcaattcaatagtatgttcctgattttgagatgctaagtggtattgcacagttgtcactttatcaagtgtgtacaacagtcccatgaagtttatagagcatacccttgtatagcttcaggtgctaga

SEQ ID NO: 2663 - DNA, 248 bp, Homo sapiens
  misc_feature (73)..(73): n is a, c, g, or t
tctgacctagagctttatttaagttttagaaatatgtaatacctttcatcattccatcatccctaaattctgntacccaaataatggctaatgttacaaaaagttatactcccagagacccaaagcttgacatttacctattgtattgagaaattattcccaataccaataaaggaatggtcctattttttaacccctcttttaactagcctaatacctcccgcaaggccctcaacgtcctggggcta

SEQ ID NO: 2664 - DNA, 258 bp, Homo sapiens
  misc_feature (103)..(103): n is a, c, g, or t
aatgcaggtatcacttttactccattgttatctgacctagagctttatttaagttttagaaatatgtaatacctttcatcattccatcatccctaaattctgntacccaaataatggctaatgttacaaaaagttatactcccagagacccaaagcttgacatttacctattgtattgagaaattattcccaataccaataaaggaatggtcctattttttaacccctcttttaactagcctaatacctcccgcaagg

SEQ ID NO: 2665 - DNA, 265 bp, Homo sapiens
gtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttggaagccatttttgtaatgaataaatgttcatgctgtacagtatctgtagcatgccgttctggattaataa

SEQ ID NO: 2666 - DNA, 257 bp, Homo sapiens
atatcatctccggttcgatcgcgtccagatggaaaacggaagcagaggcttctaatcgtcgcatttactggctccagtgcaacacatccatctgaaaacactcggaagtctggtgcttggagagggtgccattgtctcttgtacataaggtcatgacgtgtctatgtcaaaagttcttatatatttcttttataagctgaaagaaggtctatttttatgtttttaggtctatgaatggaacgttgtaaatgcttgtc

SEQ ID NO: 2667 - DNA, 281 bp, Homo sapiens
aaccataggcgacagcggacaccaacaaacgagcagaaactccaccagctgaaacgcagccatgcagagcaaacacagagcaaccacgcatcatcatacaaaaagccagagccaccacggaacccatacacgaaacagtaacaacaagcagcacaacaacaccgccgtccgacacacacgtcgatcaaatacagacaccgatagcaaaacatagcaacaacgagagcgaatcgaaagcctcaacgcctcaaccccctagtcagtcccacgccacatatacg

SEQ ID NO: 2668 - DNA, 63 bp, Homo sapiens
tgactcctgacggttggtcttttgctctaaaatcatccgactcctcgtcgggtgatcctaaaa

SEQ ID NO: 2669 - DNA, 66 bp, Homo sapiens
actgccaagctccaggatttcaaatccttcctgcttaaggactcagaaacaagtcagcgtctggcc

SEQ ID NO: 2670 - DNA, 206 bp, Homo sapiens
tcagcgtctggccaacctcaggcaacgggtggagcagtttgccagggccttccccatgcctggttttgatgagcattgaaggcacctgggaaatgaggcccacagactcaaagttactctccttccccctacctgggccagtgaaatagaaagcctttctattttttggtgcgggagggaagacctctcacttagggcaagagcca

SEQ ID NO: 2671 - DNA, 89 bp, Homo sapiens
ttcctccatgattttagtggcctccttttgtacttcactcagatactaaatagtaggttattcctttatataaggtacatttctgctcc

SEQ ID NO: 2672 - DNA, 226 bp, Homo sapiens
  misc_feature (28)..(28): n is a, c, g, or t
gagtgattgtttcttcatgccagagaanatgaattgcaatcatcaaatggtgtttcataacttggtagtagtaacttaccttaccttacctagaaaaatattaatgtaagccatataacatgggattttcctccatgattttagtggcctccttttgtacttcactcagatactaaatagtaggttattcctttatataaggtacatttctgctcctcaaacaaat

SEQ ID NO: 2673 - DNA, 150 bp, Homo sapiens
ataacattggttatctggactattttggactagtgcacaggtgagctaaacaatctagacatctgaatacttgctggatctctgctctcacactaagtcatactatgctactataaatcaactataagaatcattagaacgaactcgcag

SEQ ID NO: 2674 - DNA, 144 bp, Homo sapiens
ctctttgtcccggataggctaatcaatacccttggcactgatgggcactggaaaacatagagtagacctgagatgctggtcaagccccctttgattgagttcatcatgagccgttgctaatgccaggccagtaaaagtataaca

SEQ ID NO: 2675 - DNA, 99 bp, Homo sapiens
  misc_feature (50)..(50): n is a, c, g, or t
  misc_feature (66)..(66): n is a, c, g, or t
cttgccttaaagcagcatacttattttttgtttatttattgtgagctttntactttattaagattntacagcgaaacccttacatgagtaattgaaatg

SEQ ID NO: 2676 - DNA, 188 bp, Homo sapiens
tgaagttcactaccatttgtcaagaatcaccctttccaaatcctctgggttttgactttttggcttccacttcacccaaaatgttaaaatttttacttaattcatagccttccttggtttcatatttgtttgcatttaattcatgtttgagtctcttaactgatggatgcccacttgccttaaagcag

SEQ ID NO: 2677 - DNA, 258 bp, Homo sapiens
tcatagggagaagagcgctgcttgtggcagggtggcgtgtggctgtcattaaagtgcgttcctttaatgagcgctcagggctcccaggggcctgctgctatgccatggggtggggctgccagcagggcagggggttgatcccatcacatctccccagacacatcctcaggaaaccacctcaaaaccacctaagaacaaaggaagttatcacactggggacagggacacgggtcagagttcagctacgctggaatggaa

SEQ ID NO: 2678 - DNA, 273 bp, Homo sapiens
tttcctcaccacacttcatagggagaagagcgctgcttgtggcagggtggcgtgtggctgtcattaaagtgcgttcctttaatgagcgctcagggctcccaggggcctgctgctatgccatggggtggggctgccagcagggcagggggttgatcccatcacatctccccagacacatcctcaggaaaccacctcaaaaccacctaagaacaaaggaagttatcacactggggacagggacacgggtcagagttcagctacgctggaatggaa

SEQ ID NO: 2679 - DNA, 213 bp, Homo sapiens
gaaaaacaatcttattccgagcattccagtaacttttttgtgtatgtacttagctgtactataagtagttggtttgtatgagatggttaaaaaggccaaagataaaaggtttctttttttttccttttttgtctatgaagttgctgtttattttttttggcctgtttgatgtatgtgtgaaacaatgttgtccaacaataaacaggaatttta

SEQ ID NO: 2680 - DNA, 250 bp, Homo sapiens
atatgtctgtttttccactaccgtatcattgctgttcacatgtaatgtgttgtttgttcacaacaagcgcctggttacacattacactgacgaatgtgctgatgctccagccatggctttgatgcttctgtcatttttaacctcttctattaatatttactgcctgtgccattcttttccttgttggccattcacaaggcttggataatcgtgtgacattttgagagccatcagatgttacgtttctcaa

SEQ ID NO: 2681 - DNA, 256 bp, Homo sapiens
  misc_feature (48)..(48): n is a, c, g, or t
  misc_feature (223)..(223): n is a, c, g, or t
gtaaatagcttgtgctcagactcctctgcgtggagaaggtgggtgcangaggcagaccctccccccaaagccccctggggagatcttcctctctctatttaactgtaactgaggggggatccccaggtctgggggatgggggacaaccttggggccacaggatactgggtttgcttcagggggtacccatggcccccctgccctcggcctgggaatcagtggntactggcatctgaattaaaatgttcttccccga

SEQ ID NO: 2682 - DNA, 236 bp, Homo sapiens
gaaagcgcgaaaacaacacagagaacacaacaagaggagatgagtgggcgcgtcagaatgaaagcgggggccaccaccacgcaaccaccatgaaagaagacgacgcaacagaaaacaaaaaaaggaggccgacaccataacggaggagaacagaagagaggagaagacatcgatcggggagaaaagagaccacagcaacagacggaacaaggatgacgcacaacggagcagaagaa

SEQ ID NO: 2683 - DNA, 283 bp, Homo sapiens
taagtctcgaatggtgtggcccttctgagtagcgtgatgaaatctctcgctgtccgggtccacccggccggggatgtgagtcatccccttggtccagcacatccacgctgtatacaccacccaccctggtagtgacttagtaaccggccttggtgatcagggatcaactatgccaacatccgcagtgccctgtggcccaaagcagggcctcacgtttggctttaacgggggggccccaggggaggccaggaatagggggattgcctgggtggattccagaata

SEQ ID NO: 2684 - DNA, 231 bp, Homo sapiens
tatcttttactatgggagtcactatttattattgcttatgtgccctgttcaaaacagaggcacttaatttgatcttttatttttctttgcttttatttttttttttatttagatgaccaaaggtcattacaacctgcgctttttattgaatttgtttctggcctttgttaagttctattggaaaaaccactgtctgtggtttttttggcagttgtctgcattaacctgttc

SEQ ID NO: 2685 - DNA, 157 bp, Homo sapiens
tgtcatccccttactttaattcttgggcctccaataagtgtcccataggtgtctggccaggcccacctgctgcggatgtggtctgtgtgcgtgtgtgggcacaggtgtgagtgtgtgagtgacagtgaccccatttcagtcatttcctgctgcaact

SEQ ID NO: 2686 - DNA, 268 bp, Homo sapiens
gcccagggccatggaaggacccttaggagttcgatgagagagaccatgaggccactgggctttccccctcccaggcctcctgggtgtcatccccttactttaattcttgggcctccaataagtgtcccataggtgtctggccaggcccacctgctgcggatgtggtctgtgtgcgtgtgtgggcacaggtgtgagtgtgtgagtgacagtgaccccatttcagtcatttcctgctgcaactaagtgagcaacacagtttctctgatgt

SEQ ID NO: 2687 - DNA, 93 bp, Homo sapiens
aaacgaaacgagtgatgatgaggctttgttactttgttaggtacgaatcacataagggagattgtatacaagttggagcaatatccatttatt

SEQ ID NO: 2688 - DNA, 44 bp, Homo sapiens
gatcggaatgcaaatctagttctgggttcactgccttctcactt

SEQ ID NO: 2689 - DNA, 80 bp, Homo sapiens
gatcggaatgcaaatctagttctgggttcactgccttctcacttgtcccctcgcccctagtaactttctgttcctcacca

SEQ ID NO: 2690 - DNA, 251 bp, Homo sapiens
tattagaaaagttgaatcgcatgactacatttatacaggggaaattcaagcatttgtgtgtgaattaaatgcttcgttaataggataagcaggtgattcatttggaacttatgggatgcagcataaccaggtgaaatctaatggtgatttatttccaaagaccaccaggtttgttcaagtgcattgctagtctgtgtttgtgtttaacccatgcaacaatcctcatgacagtaacaaggattatgaccaat

SEQ ID NO: 2691 - DNA, 86 bp, Homo sapiens
aaaatttgcagtactcctgattattcttttattgtttttgactgttccctgtttttttctgtgactgctgtaacttaaagtttttg

SEQ ID NO: 2692 - DNA, 37 bp, Homo sapiens
ggtatttgccctggggggatcctgataccctgggctg

SEQ ID NO: 2693 - DNA, 237 bp, Homo sapiens
aaaaggtccagttttacagcctgcaattaattcagggctgcgttggcattaaaaaagaaaatatatatatatatatatatatatatatatatatatatgtatattatatatacagtagcttacacttaaaagaggaaaaatttgcattaacattgcatattctgatatgtaccatattaacacataacaggcattttatttatgcttcatagaatcagacagacacaactttcaaaa

SEQ ID NO: 2694 - DNA, 240 bp, Homo sapiens
cagcccactgagaagtcaaacatttcaaagtttggattgtatcaagtggcatgtgctgtgaccatttataatgttagtagaaattttacaataggtgcttattctcaaagcaggaattggtggcagattttacaaaagatgtatccttccaatttggaatcttctctttgacaattcctagataaaaagatggcctttgcttatgaatatttataacagcattcttgtcacaataaatgt

SEQ ID NO: 2695 - DNA, 57 bp, Homo sapiens
ggaataacaagaaagatctatgaacagaacacaaacaaacacagcaagctaacaaaa

SEQ ID NO: 2696 - DNA, 212 bp, Homo sapiens
tggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagcttttta

SEQ ID NO: 2697 - DNA, 258 bp, Homo sapiens
aaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggattttt

SEQ ID NO: 2698 - DNA, 290 bp, Homo sapiens
aaaatcagtgccctccctgttgctctaggaggctcctgctggcttggtagaagacagaattcgatctgcctgtccctttttcccctggggtttgacacacaggctcctctcagcatgaggtggagcagtgaccaggtggagcagtgaccaggacgcctctggcccagtgctgcccagcctccccgcccgctcccaggcgccccatgtcctcacaggccaggacgccatggcaggatggagaggacttggtggatttttgtttcttgcctgacctcagtttcatgaaagaa

SEQ ID NO: 2699 - DNA, 79 bp, Homo sapiens
gtgtctgtatgtttaagttatcgtaaatatttaaaatgtaaacatggctgttttgttatgccaccctgtaccaggattg

SEQ ID NO: 2700 - DNA, 131 bp, Homo sapiens
ttaaagtattttttgtgctgtgaacattttctgccaaagaccatgatgtgtgtctgtatgtttaagttatcgtaaatatttaaaatgtaaacatggctgttttgttatgccaccctgtaccaggattgctg

SEQ ID NO: 2701 - DNA, 160 bp, Homo sapiens
ctgtagtagcgagtgatctggcggggggcgtctcagcaccctccccagggggtgcatctcagccccctctttccgtccttcccgtccagccccagccctgggcctgggctgccgacacctgggccagagcccctgctgtgattggtgctccctgggcctc

SEQ ID NO: 2702 - DNA, 277 bp, Homo sapiens
aaaaatagaggctcaccccagtctcgtcggcaacaggggggcccccaaagaggagggcatatatagacgccacgcgagcggcggctataaaccacacgctgcagggggaaacacgccgcacctagcgccctggggaagacgcccatacatgagggcggggccacacgtgggacacacactcaccgaaaattagcgccgggggaacaacaatgcggggtagcgggcaacacagcggagggcgcgggaagaaatgccacgggcatatgagccataaccg

SEQ ID NO: 2703 - DNA, 52 bp, Homo sapiens
ttggttttgtaagctaacaaatctataataatttgagtatccccggggaatg

SEQ ID NO: 2704 - DNA, 250 bp, Homo sapiens
gtagaagcagtgtgatccagggattactggcctccagagtcttcaagatcctgagaacttggaattccttgtaactggagctcggagctgcaccgagggcaaccaggacagctgtgtgtgcagacctcatgtgttgggttctctcccctccttcctgttcctcttatataccagtttatccccattctttttttttttcttactccaaaataaatcaaggctgcaatgcagctggtgctgttcagattct

SEQ ID NO: 2705 - DNA, 233 bp, Homo sapiens
tgagccctgtgagaggcacgactgtctatgccaatgaggctcggtggggggctctcaagtgcctgatcctgccctgggctcagagccagcccagagggaagcaactgcacagccccacaggccctccttgggcactgtccccccagacccatctcagagctcagagggtacaagctccagaacagtaagcaagtgggaaaataaagacttcttggatgactgaagacaaaaaa

SEQ ID NO: 2706 - DNA, 174 bp, Homo sapiens
atcaacctggaaggaaagaccttctactccaagaaggacaggcctctctgcaagagccatgccttctctcatgtgtgagccccttctgcccacagctgccgcggtggcccctagcctgaggggcctggagtcgtggccctgcatttctgggtagggctggcaatggttgcctta

SEQ ID NO: 2707 - DNA, 194 bp, Homo sapiens
tgcgcggacaacgaggtacaggacagggcccagagccaaagctggtaccctgacccaagattcccggcccacaacggggataaaccggcacggaccccataaaagaggaaccagataacatcaccagaaaagccagggtaaaccgtgactacagaaacgccgaagaacaaacagcacgcacaagcgcggcaaca

SEQ ID NO: 2708 - DNA, 194 bp, Homo sapiens; identical to SEQ ID NO: 2707

SEQ ID NO: 2709 - DNA, 193 bp, Homo sapiens
gggtccctgagctccctagagtcggccaccacagattcagacttggactatgattatctacagaactggggacctcgttttaagaaactagcagatttgtatggttccaaagacacttttgatgacgattcttaacaataacgatacaaatttggccttaagaactgtgtctggcgttctcaagaatctagaa

SEQ ID NO: 2710 - DNA, 299 bp, Homo sapiens
gggccccaagtgaagctgctcgcagctggagtgagaggcaggtggcggccggggccgaagccagcagtgtctaaacccccggagccatcttgctgccgacaccctgctttcccctcgccctagggctcccttgccgccctcctgcagtatttatggcctcgtcctccccacctaggccacgtgtgagctgctcctgtctctgtcttattgcagctccaggcctgacgttttacggttttgttttttactggtttgtgtttatattttcggggatacttaataaatctattgctgtcaga

SEQ ID NO: 2711 - skipped

SEQ ID NO: 2712 - DNA, 262 bp, Homo sapiens
gagtaggcaatttcttcagttcttccacaagaaatcaaagcaacagcactttgatgtgcagcaatacaacaagttaaaagaagaccttgctaaggctaaagaatccctgaaacaggcgcgtcattctctctgtttgcaaatgcaagtagaagaactcaatgaaaagaattaatcttacagttttaaatgtcgtcagattttccattatgtattgattttgcaacttaggatgtttttgagtcccatggttcattttgattgt

SEQ ID NO: 2713 - DNA, 290 bp, Homo sapiens
  misc_feature (240)..(241): n is a, c, g, or t
aaggctctttctccttggagacaatgggaactggagggtgagaggaaaggtgggtctgtaagaccttggtaggggactaattcactggcggagttcggccaccaccctacttcatttttaaagggacacccaagaggggctgctttccattgcctggaacccttgaattccatctggggcctacccccaacccaaagaaaaacaaataaaagcccttaaccccccgggagaaaagaaagnnagaggaaaaaaacctcccgagggccattctaattgttccgcggtgggcg

SEQ ID NO: 2714 - DNA, 255 bp, Homo sapiens
taaaaattggacagattagcccaaaaaaagacacaatcacaacaaacaaaacaaaaactattgttggcggcactgtgcgccccaaagaaactctgtaaaacacctagcggttaggcacagcggccccataggaaagcgaacatgtgcaaacatgtccccagaaaaacccggaacaaaaaaacggcgcggaaacgcacccaaaaaacacgcccggggaaccgcggttttggacaaaccagagacatcacaacaaaa

SEQ ID NO: 2715 - DNA, 120 bp, Homo sapiens
gcacatgggccttggggtgacaaattccctcctttggatgaatgtacccctgggggggatggtttcatactggaaggattaattttttatttcattcccatgggccataattctaaaaat

SEQ ID NO: 2716 - DNA, 133 bp, Homo sapiens
tttccactgaaaagcacatgggccttggggtgacaaattccctcctttggatgaatgtacccctgggggggatggtttcatactggaaggattaattttttatttcattcccatgggccataattctaaaaat

SEQ ID NO: 2717 - DNA, 112 bp, Homo sapiens
ggaaaaggagtggtatttgaatgctttctgtgggacaatgtaccccctaaacacatcatgtatttttaaattgccaccctacctaaaataaaaccataagccatatttgaaa

SEQ ID NO: 2718 - DNA, 103 bp, Homo sapiens
aaaatgccagcaattttaatctagcagtgttgaagctgggaattttttggcgcaatccatgtagcagtgacccaggcttgggagccagaaacaagtgtgacct

SEQ ID NO: 2719 - DNA, 228 bp, Homo sapiens
aggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttga

SEQ ID NO: 2720 - DNA, 173 bp, Homo sapiens
tgtactcatgttttaccaactccggaatgtgaatgctataatactctttttatatcacaaaggtcctcaagcactttatttctattctaatgcattggtgtgtccttttaccattaactcacaactgtttcctccagactggattacagcaaatactcctgggtcaaaacaaa

SEQ ID NO: 2721 - DNA, 277 bp, Homo sapiens
tactatgccacctgcaagtgatgctacagcttccagcccgttgccccactcatctgccgcctttgcttttggttgggggcagattgggttggaatgctttccatctccaggagactttcatgtagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaa

SEQ ID NO: 2722 - DNA, 292 bp, Homo sapiens
tctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagtttt

SEQ ID NO: 2723 - DNA, 232 bp, Homo sapiens
tcttccctttccgagataacgtagacagagctaaaaggagtggtgtggcgtacattgcggctccctccggttctgctgctgacaaagttgtgattgaggcctgcgacgaactgggaatcatcctcgctcatacgaaccttcggctcttccaccactgattttaccacacactgttttttggcttgcttatgtgtaggtgaacagtcacgcctgaaactttgaggataacttt

SEQ ID NO: 2724 - DNA, 201 bp, Homo sapiens
ggctcatgctgcctgatggcatcaccgtggaggtcattgtggtcaaccaggtcaatgccgggcacctgttcgtgcagcagcacacacaccctaccttccacgcgctgcgcagcctcgaccagcagatgtacctctgttactctcagcctggaatccccaccttgcccaccccagtggaaataacggtcatctgtgccgccc

SEQ ID NO: 2725 - DNA, 255 bp, Homo sapiens
aaattgcctttctctatttgttaagaatttttatacaagaacaccaatataccccctttattttactgtggaatatgtgctggaaaaattgcaacaacactttactacctaacggatagcatttgtaaatactctaggtatctgtaaacactctgatgaagtctgtatagtgtgactaacccacaggcaggttggtttacattaatttttttttttgaatgggatgtcctatggaaacctatttcaccagagttt

SEQ ID NO: 2726 - DNA, 163 bp, Homo sapiens
gagcgcagagatcggccctactagatgcagagaccccgcagagctgcattgactaccagatttattttttaaaccagaaaatgttttaaatttataattccatatttataatgttgggcacaacattatgattattccttgtctgtactttagtatttttcac

SEQ ID NO: 2727 - DNA, 250 bp, Homo sapiens
agttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaa

SEQ ID NO: 2728 - DNA, 215 bp, Homo sapiens
acaaggtacatgcattatgtgtcacattactgggcaaactgttcaagtatttttttttaaacctccctgtatagaaaaaaatcattaaggatgtaaaagccatgcttgcctatttgctgtatacatgtaatgaaattgtagataaagtgtagtgcattgaaacaaatgaacaaaaagtagatacttttactatacaagggtgctggtgcagaaaa

SEQ ID NO: 2729 - DNA, 246 bp, Homo sapiens
gccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttct

SEQ ID NO: 2730 - DNA, 214 bp, Homo sapiens
gatcaagatacggaagagcccagcactccacgatgctccatcatgcccctttgcagaaaatactgcctcctccagtaaacactattctgatgtcactatagataagttttgcctcttcgtgaactttgtataaatagaactgaacaatatgaactgtcctgtgtgatttcttgtatttcattatgggtggtgtgctattgtatcaacagggtat

SEQ ID NO: 2731 - DNA, 140 bp, Homo sapiens
tcccggagcctctgcccatggcggggtggagacccggaaccagcagccccctccactggcgacacaactgcaccttccctcatttcagtctcccgcacacttattcctcctcccctcttcccggtggcacctctccacct

SEQ ID NO: 2732 - DNA, 64 bp, Homo sapiens
ttcttcccgatctgaacccctgttgactaatcttgcctgggtttgtgtaggtctgcaggaagga

SEQ ID NO: 2733 - DNA, 265 bp, Homo sapiens
agccgctgccaagtctgtatgagaagaacataatgaagcctgactcagctaatgtcacaacatggtgctacttcttcttctttttgttaacagcaacgaaccctagaaatatatcctgtgtacctcactgtccaatatgaaaaccgtaaagtgccttataggaatttgcgtaactaacacaccctgcttcattgacctctacttgctgaaggagaaaaagacagcgataagcttttcatagtggcataccaaatggcacttttga

SEQ ID NO: 2734 - DNA, 258 bp, Homo sapiens
agagacgcccctgctaacgggaatgctaatgaggaaaatggggagcaggaggctgacaatgaggtagacgaagaagaggaagaaggtggggaggaagaggaggaggaagaagaaggtgatggtgaggaagaggatggagatgaagatgaggaagctgagtcagctacgggcaagcgggcagctgaagatgatgaggatgacgatgtcgataccaagaagcagaagaccgacgaggatgactagacagcaaaaaaggaa

SEQ ID NO: 2735 - DNA, 211 bp, Homo sapiens
  misc_feature (159)..(159): n is a, c, g, or t
aactcagctggacttttcttgctttaataacagctttattgagatacaattcacatatcacgaaattctttttaaaaattttacagttcaggccgggcgcggtggctcatgcctgtaatcccaacactttgggaggctgaggctggcgggtcacctgangtcaggagttcgagaccagcttggccagcatggcaaaatcccgtctccacta

SEQ ID NO: 2736 - DNA, 293 bp, Homo sapiens
ttgtaaatagcaacctaaaggcgtattttggcactggtctggggacattccccatctctcatcccttttcccccttcacagatggtggtgggcttcgctctacaaagaggactctgatgttactcttgagcttatgagccagagagctgaaaaccgcaggcttgttgtgttaagttacaaggaaaatggatttggtaattaaaattagaagaaacacaccttcaaacttcaacttctttaaaagaaaaaaaaaactgtcctatcttgttctgtaaaatattagaacgctttgt

SEQ ID NO: 2737 - DNA, 164 bp, Homo sapiens
aagagaatttatgtggcttctcatttttaaatcccctcagaggtgtgactagtctctttatcagcacacacttaaaaaatttttaatattgtctattaaaaataggacaaacttggagagtatggacaactttgatattgcttggcacagatggtattaaaaaa

SEQ ID NO: 2738 - DNA, 242 bp, Homo sapiens
aaggttatcaaccacacatccagtcctgacatggagcttttcagtgtttggagacatttctcaatcccctgctgtggtaggaactccagtggtgaacggcttgcgcgcctgcagccagagttgcagggaaagctcgtacttactgcgagcagcatgtaatcttttttcttcctggacataaagatagcttgagtaaactgttctatttcattctcttcactctttttactgtcttgcaaaaa

SEQ ID NO: 2739 - DNA, 274 bp, Homo sapiens
aggctgtgtcattggcagggcttcacatgcaggaggcctctctcaggtgagtccaggttaaactgttgagttgtggcttcaacagatatgtatggcatgctgggatgtgccaggtgcctgcgttgtgccagttgctggagaggtagtgtgagcagagcagctgaaatcttgccatcaagcaaccctcattctcatgcctgtaggtttccattgctctgtcccaggacacttgcgtgccagagacgccacaacttcatgtccctgtctcttgcaa

SEQ ID NO: 2740 - DNA, 278 bp, Homo sapiens
cacttaacccctcagctatgaaaaggcttccaggagtttccatgacataacaaaacaacaatacaagcgcctcaccttagcattcaaggcttgtctagtctgcccaacaattacttatcctcacctagctcctaccagtcttcttagagactctccagtcagaacatgtgtcgcatagttccactccacacctctctgctgacagcacattcatgcagacaagtctttccactgtctcagacttccgcaggcttacctgcgcaggcaagtctaaccaa

SEQ ID NO: 2741 - DNA, 284 bp, Homo sapiens
ggaaatccgacgatgactcttgggtgagcaacggcacctatttggaacttagaaaagatcttggtttttccaaactggaccatcctgtcttatggtgaaaaagtaaagaagaaagataacattagtgtatttctcctgtgcttgccttctgaagtggcacaaacctgtgtttatatatttaaaagatactctaggatgatcacttgtgcttagcttaacattgtaactctttaagtctatattttcctcagtgcgtttctttacaatttcaaatgttaccctga

SEQ ID NO: 2742 - DNA, 87 bp, Homo sapiens
agacttttatctaacctgcactcatgtacagattattaaaagttttaaaatgtaactgatcagtattgatcaatcattgtcttgatt

SEQ ID NO: 2743 - DNA, 45 bp, Homo sapiens
atttccatcacctttgaaacatagcttttagcttgggaaatctga

SEQ ID NO: 2744 - DNA, 289 bp, Homo sapiens
  misc_feature (150)..(150): n is a, c, g, or t
gatcattaggtacttttgtttcaacctttattcctgtaaatatttctgtgaaaactaggagaacagagatgagatttgacaaaaaaaaattgaattaaaaataacacagtctttttaaaactaacataggaaaagcctttcctattattntctcttcttaagcttctccattgtctaaatcaggaaaaacaggaaaacacagcttttctagcagctgcaaaaatggtttaatgcccccctacatatttccatcacctttgaaacatagcttttagcttgggaaatctga

SEQ ID NO: 2745 - DNA, 281 bp, Homo sapiens
gaattttttaatatgcacaggccatattctcttttgaatagtttcatttcatgctcactactgttggcactaaatgtaattttttacacttataattattttatatgtcaaacaatattgagatggatgatcaagtttattcaccaaatgatttgaatatatttctttaaacaaactgtttctcaagaattccattttccttcaaaaaaatttacacaatatcatatagctcacacatacaggcagagccagaatgtctattctaagtaccacgttgtgga

SEQ ID NO: 2746 - DNA, 211 bp, Homo sapiens
tcctggcactggcaaaaagaactgtgaaagtgaaattttattcagccgactgcccaaaaagtgggaaatgggaataggattgtcccccagtgtccatggtaacttttgttttaacctttgcaccttctcagtggctgtatggcggctgcaaccggcctcacctgttttccccccaaaggggatttctccacctcttggttggaaacaccaa

SEQ ID NO: 2747 - DNA, 241 bp, Homo sapiens
ataattatgggctcacttcctactggagatgttgaaagtctaaatcggtttgaccattttgattgatggcacaatctggtttagaaaactttgtttagatcaatgacataaccctgctgcctctgcctgcccttcccctcccttctcccatccccttttccctatctggtgtctgtactttgatgaaggtgagctataatattggtggttaatataatccagaaggcttagttctgtgtgt

SEQ ID NO: 2748 - DNA, 279 bp, Homo sapiens
ggatataaacactttgacaggagaagaaagggtgcctgttgtcaataaacgaaatgggaagaagatgggtggagctatggcgcctccaatgaaggatctacccaggtggctggaagaaaatcctgaatttgcagttgctccagactggactgatatagttaagcagtctggttttgttcctgagtcgatgtttgaccgccttctcactgggcctgtagtgcggggagagggagcgagcagaagaggaagaaggcccaaaagtgagatcgccagagcagc

SEQ ID NO: 2749 - DNA, 208 bp, Homo sapiens
gtgtggtgattgttcaggtcgaatctgttgtatccagtacagctttaggtcttcagctgcccttctggcgagtacatgcacaggattgtaaatgagaaatgcagtcatatttccagtctgcctctatgatgatgttaaattattgctgtttagctgtgaacaagggatgtaccactggaggaatagagtatccttttgtacacatttt

SEQ ID NO: 2750 - DNA, 163 bp, Homo sapiens
agcctcacctcacccaagctcaagtgatcctctcacctcagcctcccaagtagctgagattacagatgcacatcaccacactcgggtaattttttttactctctgtagagatgcagtcttgctatgctgtgcatgctggcctcaaacttgtaggctcaagtaa

SEQ ID NO: 2751 - DNA, 196 bp, Homo sapiens
cttctagccgtcaaactctgatcgacttacacttaagactgtgtctttggtagcctaccctattccacttttattacaaaggcagctcttaagacataaatccatctcttcaggctcgaactgcaaaacacacgtcgagaggtgacaatgttgggactgtcaaaaagaacttaaagagtgggataaccagccgggc

SEQ ID NO: 2752 - DNA, 150 bp, Homo sapiens
gaccatcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatctt

SEQ ID NO: 2753 - DNA, 240 bp, Homo sapiens
tcctcaggagcagtctcacaggtgctggacagcctggaagagattcatgcgcttacagactgcagtgaaaaggacctggattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaat

SEQ ID NO: 2754 - DNA, 47 bp, Homo sapiens
ccctgctgcctctgatcgtaggaattgaggagtgtcccgccttgtgg

SEQ ID NO: 2755 - DNA, 167 bp, Homo sapiens
cgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtgaca

SEQ ID NO: 2756 - DNA, 202 bp, Homo sapiens
ccctgctgcctctgatcgtaggaattgaggagtgtcccgccttgtggctgagaactggacagtggcaggggctggagatgggtgtgtgtgtgtgtgtgtgtgtgtgtgtgtgtgtgcgcgcgcgccagtgcaagaccgagattgagggaaagcatgtctgctgggtgtgaccatgtttcctctcaataaagttcccctgtga

SEQ ID NO: 2757 - DNA, 233 bp, Homo sapiens
ggctatttccttggtataggtacaaaacgtattactgcttgtctgtaataatttttttctttgtctatatatggcactgggcgttaccacttattcttaataatcaccatatttgtttgatgtcttccatcattttagattgtaattctgtgaggcaaagcatcatgtctgtgtgtttttttttttttctgttatattctcaacacgatgtttgacagatagtagatacccaa

SEQ ID NO: 2758 - DNA, 182 bp, Homo sapiens
tttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggca

SEQ ID NO: 2759 - DNA, 229 bp, Homo sapiens
tacttgaaattctcttttgtgtctcctagtagcttcctactcaactatttataatctcattaattaaaaagttataattttagataaaaattctagtcaaatttttacagatattatctcactaattttcagacttttgccaaagtgtgcacaatggctttttgttaataaagaacagattagttttgaagaaggcaaaaatttcagttttctgaagacagcatgttat

SEQ ID NO: 2760 - DNA, 265 bp, Homo sapiens
gactttggccaggtaggacttgacttagaggcagaatttgaaaaagatctcaaagacgtgctcggttttcatgaagccaatgacggcggtttctggactcttccttgaccctgttctgtaaagactgaagcatccccacctcaggattcagctgatgggaccctggcttggactgttgattgccagtgagtctgggatgtaattggctgccctcaggacccaaacccagacacttcataggattatcacaccctccatctttatt

SEQ ID NO: 2761 - DNA, 264 bp, Homo sapiens
taaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcgatacattta

SEQ ID NO: 2762 - DNA, 255 bp, Homo sapiens
taaccacaagacctctctataatggtaaatgtaagacatcaccattttatcactcaaagtatgttattgaaagtttctatttggttgataaaaggaacaattttttcccacttttgatgcctgtgatgcaattttttattgcctacaatgagatacacttagtacaaaaaatgaaaatctggtatttcaaaattgcatttcttgtataataggtcagatttattaactactcatactttttctttacactaatcg

SEQ ID NO: 2763 - DNA, 149 bp, Homo sapiens
tcataataagttgcataggtttaataatttttaattatatggcttgagtttaaattgtaataggcgtaactaattttaactctataatgtgttcattctggaataatcctaaacatatgaattatgtttgcatgttcacttccaagagc

SEQ ID NO: 2764 - DNA, 199 bp, Homo sapiens
tcataataagttgcataggtttaataatttttaattatatggcttgagtttaaattgtaataggcgtaactaattttaactctataatgtgttcattctggaataatcctaaacatatgaattatgtttgcatgttcacttccaagagcctttttttgaaaaaaagctttttttgaatcatcaagtctttcacatttaa

SEQ ID NO: 2765 - DNA, 83 bp, Homo sapiens
atcacaggtttgagctgaattatcacatgaatataaatgggaaatcagtgttttagagagagaacttttcgacatatttcctg

SEQ ID NO: 2766 - DNA, 154 bp, Homo sapiens
aatgctacgaatattaaacacttcaaaaactgcacctccatcagtggcgatctccacatcctgccggtggcatttaggggtgactccttcacacatactcctcctctggatccacaggaactggatattctgaaaaccgtaaaggaaatcacag

SEQ ID NO: 2767 - DNA, 279 bp, Homo sapiens
tggtattacctttttcaagctcagattcatctaatcctcaactgtacatgtgtacattcttcacctcctggtgccctatcccgcaaaatgggcttcctgcctggtttttctcttctcacattttttaaatggtcccctgtgtttgtagagaactcccttatacagagttttggttctagttttatttcgtagattttgcattttgtaccttttgagactatgtatttatatttggatcagatgcatatttattaatgtacagtcactgctagtgttcaa

SEQ ID NO: 2768 - DNA, 70 bp, Homo sapiens
aaaagtccagtggagaaaatctcaatgcttactgttactactaattgattcctactagtttccaggtttg

SEQ ID NO: 2769 - DNA, 229 bp, Homo sapiens
ggtgtttgacaccagtaggtctctttatttctgggaaatgtgtacctgtactttctgatatacagtgttcctaagtaaaaatcaattcaggggatttgtatagtgtctataggaaagtagcccatgtcttgaaatatgaaaaggaatctgaaggtcatgaaaagtccagtggagaaaatctcaatgcttactgttactactaattgattcctactagtttccaggtttg

SEQ ID NO: 2770 - DNA, 257 bp, Homo sapiens
aacactgcatttgggcaccatctcagctcccttgcatccaggtgcagcatggactgagttcttgacaacagaatgtggtcagaagtgacatatgccaacacggggtctgggtgggggctcccccacatcctttccttgcctatgagctggaacataacacatgcctatgatccagctttggtcatacccaaggggaaggtggagcaagaaatgaaaaggaacctgaatccctgaatgactgcatggatagaaccact

SEQ ID NO: 2771 - DNA, 255 bp, Homo sapiens
aagtgattggcctaaagtcaggaactaggcaagtggtcaagccatgctttgtgactttcaagttaattcttcttgttcttgtatattaaaggtcttggggtagatggtgtgtgtgaaacagtgaagtctcaacagcagaaaagaacaaaatgtaaattcatgaataatggttctggttatacttccattatcaaggctaattaagagattttgccttgagtatagcaataataaacaaatgctttatgtttccct

SEQ ID NO: 2772 - DNA, 273 bp, Homo sapiens
cttcagacacgccaagtggatggatttggattgaacgcatatgaaacaggagacgggttctcatgtgagatcaaagctcctccaaagcctgttcaagctctaagcgattctcaaatgttaccatttattaaaggtaaactacacctgttgaaggccaagttcagggcagctgttgtgatctgtgtagttaatgtatttattaatgcttgacttttaaaatcctgggcataaatagtgcagagcctcgtatgtttgtcagttcatgccgagatg

SEQ ID NO: 2773 - DNA, 257 bp, Homo sapiens
agaggaggccgttgattcacttcacgctttcagcgaatgacaaaatcatctttgtgaaggcctcgcaggaagacccaacacatgggacctataactgcccagcggacagtggcaggacaggaaaaacccgtcaatgtactaggatactgctgcgtcattacagggcacaggccatggatggaaaacgctctctgctctgctttttttctactgttttaatttatactggcatgctaaagccttcctattttgcataa

SEQ ID NO: 2774 - DNA, 216 bp, Homo sapiens
atctgattccagttaagctataaacttgtgggattttcttgtagccctatagttctgtgacttcatttgctatacgctttaaatgtgttgagcagcctatgaacctaaagacatactgcagtttgttcataaatgtattcagtcttttattctttataattgtgtgtaaatgttaactaaacagtggattcctctcgtgttacagttttgagtgaa

SEQ ID NO: 2775 - DNA, 273 bp, Homo sapiens
acgggtcccagccaattgtgatgatcctttttgctcatttcccagcctttcttgctgttaggggctaccatgggaccagctctggccagagggaactaagcaaatccaatagagatgtttctggggaaggttttgcagcccactccccatcttcctgctataaatgtgggtgtgatggctggatctggggcagccaccttgctaccatgaaggaaaggccaagacaatcatccacagctattccctccagcatctggttctgtacaaaaatta

SEQ ID NO: 2776 - DNA, 241 bp, Homo sapiens
tatacagggaagtccgttttcactattagtatgaaccaagaaatggttcaaaaacagtggtaggagcaatgctttcatagtttcagatatggtagttatgaagaaaacaatgtcatttgctgctattattgtaagagtcttataattaatggtactcctataatttttgattgtgagctcacctatttgggttaagcatgccaatttaaagagaccaagtgtatgtacattatgttctaca

SEQ ID NO: 2777 - DNA, 279 bp, Homo sapiens
gtagattcctgaactcaaggtaccagcaagaatgccttctcccagtgtgctctccccaacatcctaggcacagctttcataacccagtttcttaggtgtaagaaactgcttttatctcatttattaagtctcagaacttaacagaaaaggaagccttttaaatattctttttaattttattttagattaacagttttgtactttacatttttttatacaaccaaccagtttcttttctagccaatcatctctgaagagttgctgtttcttactgacaat

SEQ ID NO: 2778 - DNA, 187 bp, Homo sapiens
ttctttacacaggtaattgtttcaaaaggattgcatgggccaggatgtccagataagcactgtgtctcttttgcctttgtaactgttattactctttttactgctatttaatatgtaatgtatattatatgatctataatatatatgtaatatacattaaatgggaacatgtgcaaatcttacaaaa

SEQ ID NO: 2779 - DNA, 175 bp, Homo sapiens
gaatgctgaactgaaggctcagattgaggagctcaagaacgagaagcagcatttgatatacatgctcaaccttcatcggcccacgtgtattgtccgggctcagaatgggaggactccagaagatgagagaaacctctttatccaacagataaaagaaggaacattgcagagctaa

SEQ ID NO: 2780 - DNA, 64 bp, Homo sapiens
taatccatggctgtgtactgaatagtattccccgctacagctggactggactccatttagcctt

SEQ ID NO: 2781 - DNA, 171 bp, Homo sapiens
cattggtagggaactatccagtatttatattcctatgtatgtatatcagattaattttgaggcttggtattcctaaaagatttggatgtgtgtatttctttaacttgacgtaaacatgtatcacaaacatatcttttaattccaattaaaggggtgctttggcacatgctg

SEQ ID NO: 2782 - DNA, 185 bp, Homo sapiens
cattggtagggaactatccagtatttatattcctatgtatgtatatcagattaattttgaggcttggtattcctaaaagatttggatgtgtgtatttctttaacttgacgtaaacatgtatcacaaacatatcttttaattccaattaaaggggtgctttggcacatgctgaaatctgggatttt

SEQ ID NO: 2783 - DNA, 295 bp, Homo sapiens
gtataagtccctgtacttcaatgaaactaattcttaaattaaaatttctcaattattcctggctcccacagaccagaacatatggataaatccataggcaaaaaacaagcttctattttaatcaagggttatagcttcctctaccaccacctttaactgctgttccctagaaagaaaacagtactaaatattgcgtttcttcatttctttgggccaccttctcattgggatactaacagataataaaatatcaaaatgtgtaaggaagaaagatttgcagtaattccctcgtgcc

SEQ ID NO: 2784 - DNA, 250 bp, Homo sapiens
ttggcctattctggactgcaaatagcattgccaagcacttcccttaaataacttctcttttttgcaggactatcctctcagccctgccaaaaccccatcacctactctttctttactactttgcctatttaatgctggaatttttatttaaactgtagctgatttactgaaggtaattaagtgctttcatgctgtagatctcctgctagactacaggctgtacttgggagtgagagtgaaccaaatgtaa

SEQ ID NO: 2785 - DNA, 293 bp, Homo sapiens
gaagctatagatctcaagagtgcctgtgtcctacaaggaacacatatttcacaactgattcatttgccccttactctgagcacatgggataataaaagaaagttttagatcatcattatccaaaggataactttgaatgccctttttcagcatgcttctgaaaacatttcatatctcattcaatgccacatataaatggtatttgctggacagtgtggaaaacagaaacatccgtgctaaaagccaatggtaaacaccaagtttaaaaaatggattgcaaagatcgcatgtcc

SEQ ID NO: 2786 - DNA, 241 bp, Homo sapiens
aagaatcttcacttgggtgcagcctgttatctctgtaatctacctggaggtgacccatatctaggagaaaaaaaattataagcatttattacctaaaccagaattgttaaggattattttaatgacattgcaaatagagatcagcaacttggttttattgcttcccagttttttgaggctaaaaatgtgattaaaatctaatgttgatccaaagagctcttagtagagagcagagcgctta

SEQ ID NO: 2787 - DNA, 139 bp, Homo sapiens
aggcatgatggcaggcacctctaatcccagctactcaggaagctgaggcatgagaatcgcttgaacccaggaggtggaggttgcagtgagctgacagcgtgccactctactccagccttggtgatagagtgagactcca

SEQ ID NO: 2788 - DNA, 254 bp, Homo sapiens
gtccctgctgtttagatgtcgtgttgtaggagcctgttgctcagcctcccgagtagctgggattacaggtgcctgccaccacacccagctaacgtctctactaaaaatacaaaaaattagccgggcgtggtggcgggcacctgtagtcccagctactcgggaggccgaggcaggagaatggtgtgaacccgggaggcggagcttgccgtcagccaagatagcgccactgcattcccgcagcgaaagagcgagac

SEQ ID NO: 2789 - DNA, 62 bp, Homo sapiens
ttcagcagatccaggactgccgcagctctctgaacaagcgtgcacttactccatttcatctt

SEQ ID NO: 2790 - DNA, 86 bp, Homo sapiens
ctgtttcttgttggctcctctaccacccggttgataattcaggtttctgtgaccagtagctttggaatggcttatgcttgttttca

SEQ ID NO: 2791 - DNA, 166 bp, Homo sapiens
acagcccagggtctcttcagcagatccaggactgccgcagctctctgaacaagcgtgcacttactccatttcatctttctgtttcttgttggctcctctaccacccggttgataattcaggtttctgtgaccagtagctttggaatggcttatgcttgttttcaat

SEQ ID NO: 2792 - DNA, 216 bp, Homo sapiens
ttagctgggcatcaggcatcgtgcacaatcctgtactcccggctacttgtgaggccgaggtaggaggattgtttgagcctgggaggtcaaggctgcagtaagctatgattgcaccactgcatcctggttgacagagcaagattctgtaagtaagtaaataaaataaataaataaataaataaatatagcaagctggtttggagtgaggaatattaa

SEQ ID NO: 2793 - DNA, 213 bp, Homo sapiens
ttagctgggcatcaggcatcgtgcacaatcctgtactcccggctacttgtgaggccgaggtaggaggattgtttgagcctgggaggtcaaggctgcagtaagctatgattgcaccactgcatcctggttgacagagcaagattctgtaagtaagtaaataaaataaataaataaataaataaatatagcaagctggtttggagtgaggaatat

SEQ ID NO: 2794 - DNA, 269 bp, Homo sapiens
tggcccacacatcaaagtcctcgagtttaggactgaagaaaagtctgcttttgtagaaaatgtgtatgcttcatgttctcttttaccagacaatgagaataactcatactgattcctcatttttccttgacttccaggaatgtctgtgataaattcaggggacaattgcgagaattatcctcagccataagtccctcacatggttatcacctgtccattatgtatctttttgtccttcattttaacatttcttttatacatggatctta

SEQ ID NO: 2795 - DNA, 212 bp, Homo sapiens
ggagatcaaaaccatcttggccaacatggtgaaatcccatctctactagaaaatacaaaaattagctgggtgtggtggcatgtgcctgtagtcccagctactcgggaggctgagccaggagaattacttgaaccggggaggtggaggttgcagtgagccaagatcactccactgcactctagcctggtgacagagcgagactttgtcccaaa

SEQ ID NO: 2796 - DNA, 74 bp, Homo sapiens
ttgaagtgaactgagatctcgccactgcactccagcctgggtaacagagctactctgtctcaacaacaacaaca

SEQ ID NO: 2797 - DNA, 271 bp, Homo sapiens
attactgtacttagttggctatgctggcatgtcattatgggtaaaagtttgatggatttatttgtgagttatttggttatgaaaatctagagattgaagtttttcattagaaaataacacacataacaagtctatgatcattttgcatttctgtaatcacagaatagttctgcaatatttcatgtatattggaattgaagttcaattgaattttatctgtatttagtaaaaattaactttagctttgatactaatgaataaagctgggttt

SEQ ID NO: 2798 - DNA, 144 bp, Homo sapiens
tggacagcgaacataaagctctactagctaacaaataggtcttaatgataaaaacgtgggccttcagagaactaaaggtaccaatgtgtggcagtccaaaattacgaggaaaatgagttcccttcatgggtcacatcagcaatt

SEQ ID NO: 2799 - DNA, 245 bp, Homo sapiens
  misc_feature (80)..(80): n is a, c, g, or t
  misc_feature (100)..(100): n is a, c, g, or t
tttaatgaagatacaccactgagtcttgctttaagaccaaaaatatccaaacatagtatcacattatatatatctcatangaaaagctattctatcaggnaacaaaaatgaagcttccccctcacctagcagttcatctgggaatgcatcttggaaaagatccaatggcctgttggactcaaagaagccatccccaaaaaaattgtataaaagggtttattgaaatttatccaatgaccaaccgg

SEQ ID NO: 2800 - DNA, 245 bp, Homo sapiens; identical to SEQ ID NO: 2799
  misc_feature (80)..(80): n is a, c, g, or t
  misc_feature (100)..(100): n is a, c, g, or t

SEQ ID NO: 2801 - DNA, 292 bp, Homo sapiens
gaaattcaacaatgagcatctgtccttcctctataccactactagagaaagggattaattacctcctagttttcatttgaaaacaacaaaacacaagatcaatcaaatatcatttcccagttgattaaaacttatacattttatacatttcataaacaacgtttcaccacaccaaaatattgttgaattatagttaaaactggatttataaaccgagtaaactcaatagtactggttagtcctttataaatttggggatagaaaaaaaggaacattaacagctttagataag

SEQ ID NO: 2802 - DNA, 162 bp, Homo sapiens
ttaagggaggagttcctgcccaccaggaacctgctttagtgggggatagtgaagaagacaataaaagatagtagttcaggccaggcggggtgctcacgcctgtaatcctagcacttttgggaggcagagatgggaggatacttgaatccaggcatttgagac

SEQ ID NO: 2803 - DNA, 231 bp, Homo sapiens
ttaagggaggagttcctgcccaccaggaacctgctttagtgggggatagtgaagaagacaataaaagatagtagttcaggccaggcggggtgctcacgcctgtaatcctagcacttttgggaggcagagatgggaggatacttgaatccaggcatttgagaccagcctgggtaacatagtgagaccctatctctacaaaacacttttaaaaaatgtacacctgtggtccca

SEQ ID NO: 2804 - DNA, 189 bp, Homo sapiens
cagattgttcctttttagtgactcatgtttatgaagagagttgagtttaacaatcctagcttttaaaagaaactatttaatgtaaaatattctacatgtcattcagatattatgtatatcttctagcctttattctgtacttttaatgtacatatttctgtcttgcgtgatttgtatatttcactggtt

SEQ ID NO: 2805 - DNA, 294 bp, Homo sapiens
attaagtttatccttttctccatcttttctttcttgccacctaatgaaggaaatgtctccaaggtctttttgactaatagaaactaaatgtataactcgacatctagaagggtttcaagatagtagatatgtctgctgggatgttttgtcattaccctgcccaatgttgcgacgctaggagtttccttgacactacattataaataaggcccaacctgttagcaaaaatatcacattccctaattttctctcctttaactgtgtgtaatttatccaggcatgtctttagttcag

SEQ ID NO: 2806 - DNA, 285 bp, Homo sapiens
aggatcgctgcctgcgctgcgctggccgccggggattcacccggggaggcggggccgctggggaaggctcgcggggaatacagcacactttcccctaaatccctcgtccgcgccgagtgcagggctctcagagttcacctagtcccacctctcacccacaacagtttataaatggggaaggtcagacaagttagtagcagagctgggtctagaacccaggagttcgaatacaatccgaggctcatatcgagactttaagttgtccgattccgaagtttatttgct

SEQ ID NO: 2807 - DNA, 258 bp, Homo sapiens
  misc_feature (224)..(224): n is a, c, g, or t
gcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccatanatgtttcttggttgacaacatctaagacaatatt

SEQ ID NO: 2808 - DNA, 62 bp, Homo sapiens
tgacagagttggtttaggactagtggatggcatcatgtcaagttgtggataatgtcacgggt

SEQ ID NO: 2809 - DNA, 291 bp, Homo sapiens
tgttagtcctggctagtcactcataacctatgaatttaaattatcttagggcctctattttttaatctgtaaaatgaggggatcaatgtgttacagattagttgatccttaaggttccttccaaatctaagcatgtcacttcctactcctgatagtgctggtggggagcagaaaggatacggccaggaatagaaaaaagggtaaagaaacttggttgacagagttggtttaggactagtggatggcatcatgtcaagttgtggataatgtcacgggttggctgagatatac

SEQ ID NO: 2810 - DNA, 256 bp, Homo sapiens
gttaaggcacacctgctgagtaaaacaaatatttcttgtgtagcgttcttaggaatctggtgtctgtccggccccggtaggcctgttgggtttctagtcctccttaccatcatctccatatgagagtgtgaaaataggaacacgtgctctacctccatttagggatttgcttgggatacagaagaggccatgtgtctcagagctgttaagggcttatttttttaaaacattggagtcatagcatgtgtgtaaactt

SEQ ID NO: 2811 - DNA, 254 bp, Homo sapiens
ttgggaaccaaatggctccaaaagccatttgtcctccaagcgactacagggcaaagtagtgagaatcatgcccatctctctgaaataaacaatcaattcaggggcttctttctacagcccaaatgttggctagatggaacagaagtgactcaatctgtcaaatacaaaatcaggagtcaccccttccagtttcagttcatcgttcaaatggaatcatatccttcctctgtttggcttttctatgggaactgcgc

SEQ ID NO: 2812 - DNA, 293 bp, Homo sapiens
gccagttctccgcagtgaaatgctaggaaaatgtctttagaagacagaattctttctgaatgcaagtctaaaatgcttaaaagagattaaaggttttaaagacccaaatcagaaatatccattagatacatctcatttgaatcctaagagtttaaacataataaacgctgtatttatttattttatttcttttttatttttttgaggcagagtctcactttgttgcccaggctggagtgcagtggtgcagtcttggctcactgcagcctgtcttctgggttaaaacgattctc

SEQ ID NO: 2813 - DNA, 249 bp, Homo sapiens
agctggacgcctctctgacaattgtggctctggtggtgaacccctcggtgtctcttctgcacctctcaaggctgcaaagtgccaaatactcttttccaaccagctcccgaattcccccctccatctgggactgcatgtcctgcttagcgatttcaagcaatgatttcaccttttcatagacaaggacattgtctcatcagggcttgaccatcactctgatttccaatgctgacagccaagtggaggttt

SEQ ID NO: 2814 - DNA, 204 bp, Homo sapiens
tattttggcattgtactaatacctggttttttttttgttttgtttttttgtacagacagggcagcatactgagaccctgcctttaaaaacaaacagaacaaaaacaaaacaccagggacacatttctctgtcttttttgatcagtgtcctatacatcgaaggtgtgcatatatgttgaatgacattttagggacatggtgtttt

SEQ ID NO: 2815 - DNA, 271 bp, Homo sapiens
  misc_feature (133)..(133): n is a, c, g, or t
gatgaatgtgcgctttggaaatgtttaaatagatatgaaatgattaaataaaatcacagtcttgtgcaacatccatagcttacagttatttggcaactatgaaaccacagttactaatggaattaagactttntaaaaaattgcaaatgtacttatttgtatatgaaagaggtattcagctattaactcagtatttaataaacattgatatgtaatttttacttgaaatggcctaaggtttataataccaactagttcatagagctttttt

SEQ ID NO: 2816 - DNA, 74 bp, Homo sapiens
gacgtcagcctgtacaggctcccaggggtggcgtcaaatgctattgaaattgcgctgaatcgtatgctttttcc

SEQ ID NO: 2817 - DNA, 212 bp, Homo sapiens
gtgcgccgtgcccacagatgtgaaatgaatgtaatctaatagaagcctaatcagcccaccatgttctccactgaaaaatcctctttctttggggtttttctttctttcttttttgattttgcactggacggtgacgtcagcctgtacaggctcccaggggtggcgtcaaatgctattgaaattgcgctgaatcgtatgctttttccttttga

SEQ ID NO: 2818 - DNA, 240 bp, Homo sapiens
  misc_feature (191)..(191): n is a, c, g, or t
  misc_feature (207)..(207): n is a, c, g, or t
aaggaccctgaaaaatgacttctcatttcctgcctgcagaaaagagaaatattaggatagtgttgtgtgcaaaaaaatgcaagcttgcaatgagagatgcagagtgtgagggagagaggcacgaagggggtggagaaaaaagacagagaatttgaggttgactcacggctttgaagggaaaacaggaagangaagaaagtctgtctnccatgggtcggcaacccacactttacacatttt

SEQ ID NO: 2819 - DNA, 260 bp, Homo sapiens
  misc_feature (202)..(202): n is a, c, g, or t
  misc_feature (218)..(218): n is a, c, g, or t
atgacttcctgaaggaccctgaaaaatgacttctcatttcctgcctgcagaaaagagaaatattaggatagtgttgtgtgcaaaaaaatgcaagcttgcaatgagagatgcagagtgtgagggagagaggcacgaagggggtggagaaaaaagacagagaatttgaggttgactcacggctttgaagggaaaacaggaagangaagaaagtctgtctnccatgggtcggcaacccacactttacacattttttccatggg

SEQ ID NO: 2820 - DNA, 247 bp, Homo sapiens
tgtaatcacagaacatggggaagctgaggcaggcagattgcttgaggccaggagttagagaccagcctggccaacatagtcaaactctgtctctactaaaaatacaaaaattagccaggtgtaggggctcatgcctgtaatcctcccaagaagctgggctgaggcacgagaattgcttgaacccaaggggcataggttgcagtgagccaagatcatgctgctgccctccagcttgggcaataaagca

SEQ ID NO: 2821 - DNA, 270 bp, Homo sapiens
  misc_feature (103)..(103): n is a, c, g, or t
ggcattttcaccttgggcatcttcaggtgccagtctgggccatgaacatccacatctggggcatcaatgtccactttggggcccttgatgtcaacttcagggngctttagatcaccttccatcttaggcagagaaacatccacatctcctttcaccttagggcctttcagatgcaaatcaaagtcaggcatggagatcttggggggctttgatgttcatctctggcatctgtatttagggccttcagttcgcatctggacttcatattca

SEQ ID NO: 2822 - DNA, 59 bp, Homo sapiens
gagcagagcacatacctggtccgaacttacaagtctccttatagcttctctacaatctc

SEQ ID NO: 2823 - DNA, 225 bp, Homo sapiens
  misc_feature (190)..(190): n is a, c, g, or t
gcaggtctgcacagggcccgtggctgggtctcagggtcctctgaggtagtcaatgtctctcattaaggaaaaacaggatggacaagatcccttggcttgagagagaatgcctctcttaaggcacacggtccatgaggaagaaatcagtgaagtgtcctctgcattaacgtcactttcaaagaagctcccnggacatgagaaagagttctctgagcagagcacata

SEQ ID NO: 2824 - DNA, 89 bp, Homo sapiens
tgctaccacacccaattatgaatttcatcattagtttcttagtagagtccacatgtcctcagtagtaagttcatcagtgctaaatattt

SEQ ID NO: 2825 - DNA, 204 bp, Homo sapiens
ttaagagccaagttctcactgtctcccaggctggagtgcagtggcatgattatggctccctgcagccttgaactcctggactcaagctgcagcctctcgagtagctgggtgcatgtgctaccacacccaattatgaatttcatcattagtttcttagtagagtccacatgtcctcagtagtaagttcatcagtgctaaatattt

SEQ ID NO: 2826 - DNA, 268 bp, Homo sapiens
agaatggcagttgtcagtcctgtccgtgtaacagaggagtgaagtggtgaggagggcaggtctaaggcactggcagctcttttccatggattttgaactctggaggaaggcagcaactaaataactgtctcattctgctattatgcattgtattagcaaagtgaaaatatagtctatctggttacaaataacactaacttgcttaaaactttacatatcctaggaaatatctctacccctagattgcaatgtagagtcaaccccatct

SEQ ID NO: 2827 - DNA, 218 bp, Homo sapiens
attcatgtatatgagacctgctctacttcaaagctgtaatcttcttagttgataaacaatattcttaaacaaatgccttgtaaggattcttagtaaatgcagcagggcaattgctatagaccagtgcatcctcaggaggcctggttccggccattgctaacaggtttataaatggtttattaaaaagaggataggtctctcacaatgaaattcgctaa

SEQ ID NO: 2828 - DNA, 218 bp, Homo sapiens; identical to SEQ ID NO: 2827

SEQ ID NO: 2829 - DNA, 250 bp, Homo sapiens
acttaagaagtaatgtcccttggctgggcgcggtggctcatgcttgtaatcccagcactttgggagctggaggtgggcgaatcacctgaggtcaggagttcaagaccagcctgggcaacatggcgaaaccccgtctctactaaaaatacaaaaattaaccgggcatggtggcaggctataatcccaggtactcgggaggctgaggcgggagactcgcttgaacccaggagttggaagttgcagggagctg

SEQ ID NO: 2830 - DNA, 197 bp, Homo sapiens
attaccgatggttgatggacatgccaaggtattgacctcttaagccagtagtggctggttagagcttggcaaaggagcagccccctcagtttatctcagtgtgccatacaaataatattttctctggatgttacagtgtgaaaaagggtgggaagtagtgccctgttgagccatattagagccccaggcaaaagaaa

SEQ ID NO: 2831 - DNA, 183 bp, Homo sapiens
  misc_feature (149)..(149): n is a, c, g, or t
ctcctgcttcagcctgggaggcagagcttgcagtgagccgagattgcgccactgcactccagcctgggagacagagcgagactccgtctcaaaaaaacaaaacaaaacaaacaaacaaacaaaaaacaacaaagcaatcaataccaganacatgaaagaaaaatgccagttctcagagctgtt

SEQ ID NO: 2832 - DNA, 244 bp, Homo sapiens
gaggatgaggtccacatttgccacaaccaggacggctacagctacccctcgagacagatggtcagtctggaggatgacgtggcgtgaacatctgcctggagtcccgcccctgcccagaacccttcctgagacctcgccggccttgttttattcaaagacagagaagaccaaagcattgcctgccagagctttgttttatatatttattcatctgggaggcagaacaggcttcggacagtgccca

SEQ ID NO: 2833 - DNA, 44 bp, Homo sapiens
cttacttgggcagaaatgtattacttattgtgcctattttcttt

SEQ ID NO: 2834 - DNA, 196 bp, Homo sapiens
aaggtgcagcctgggattcaagttcaaggggctgcgaaacttctattactcatcactttagatatgaaagcattttaaatgttttttttaaatccattaaaaaaaaaaaacctctgttactaattgttagttgcttcttgcagggttatatcagttcctagcttgaggttttccacgggactttaaaacctcagca

SEQ ID NO: 2835 - DNA, 108 bp, Homo sapiens
agatcttgaaagttttatgtgtttaaaattgaaattgtctaaaaaaatgctctttccacattaatttagttaggatatattttcactccatttcagacacttgactca

SEQ ID NO: 2836 - DNA, 146 bp, Homo sapiens
taggctatgggctacccagatctgctgcaagtgttacatagaacatttcgtgtaaagcacacggcccggtgcctggctcgtaggaggcactcagtaaacggcggtgatattacagacacaaaacacgaggctgatgtctccctcac

SEQ ID NO: 2837 - DNA, 248 bp, Homo sapiens
tgggcagacttgtcaggtggtctaatgtgaacaaagccacagccacggggaagaacaacgtgcttcagaaccagatccaaacctcagcccacctctgccaggtgctggctttcaggcaagactctctctgaagctcgatttgccctttggtaggctatgggctacccagatctgctgcaagtgttacatagaacatttcgtgtaaagcacacggcccggtgcctggctcgtaggaggcactcagtaaa

SEQ ID NO: 2838 - DNA, 255 bp, Homo sapiens
gaagttggattcagtcgtcctggctctgccattagcccatccctggagtttaaaaaagcaagtctttttaacttcttggagttcagtttcctcacctgtgaaatgaagaagctgaataagctcatcttagggttatttgctgctccaacagtctaatattctctgaggaacaatatgcttgggttcatgggagagtcacttcccacaggaaccacgctgaccagagcacctgattgctagcctctcttctctgga

SEQ ID NO: 2839 - DNA, 275 bp, Homo sapiens
ttcccagtctttgcacagaggtcataagaggcagaggtgatgcaggcagggtaaggaaacttataaggaaccaccccagacctaaggaggtaccagcacctgcaggaagccttccttagacccccgaagcacagactatccatcccttctccgtggggaactaatgtctctcaaacacagtgtacatatggttcactggaatccccttcttggagctctctccttctggaatattagtttctacatggccaccattatagtctttcactctacag

SEQ ID NO: 2840 - DNA, 232 bp, Homo sapiens
tactcgctttagaaaagtgtcctgagcagtgcactattcatctttctaataacatgaaagtgaaatagaaaaaaaaaaaaatacatgggccactggcaaatgcaggatgcagactatttgggatgttttatggaaacaggcatgactgcaaacacttggtttgcacttggtttgattcatacaacgatcgagaagtgtggatggtttctggaaagtgccttctaagctgaaa

SEQ ID NO: 2841 - DNA, 113 bp, Homo sapiens
gcccgacccggagagctgtttcttaatctgcctggaggaaaatcccagcccccaaatttccacatacttcacatagataacactgtaacaactttgaaactaagagggagaga

SEQ ID NO: 2842 - DNA, 231 bp, Homo sapiens
cccaggccccggagtgcaatggcatgatctcagctcactgcaacctccgcctcccgggttcgagcgattctcctgcctcagcctcccaaagtgctgggattacaggcctgagccacagcgcccgacccggagagctgtttcttaatctgcctggaggaaaatcccagcccccaaatttccacatacttcacatagataacactgtaacaactttgaaactaagagggagag

SEQ ID NO: 2843 - DNA, 300 bp, Homo sapiens
tagagatacaggaacaagagatttaatattatttgaaataatattgaatactgaataatatcattgaatatataatattgaatattattatttcggccaggtgtggtggctcacgtctttaatctcagcactttgggaggctgagggaggcagatcacttgagcccaggagtttgagactagcctgggcaacacagggagagcccatctctctctctctctctttttttttaaattcattacataaaaacagattggggcaacggtttgtttatttacttgcttttgacatcatatttgc

SEQ ID NO: 2844 - DNA, 298 bp, Homo sapiens
gagatacaggaacaagagatttaatattatttgaaataatattgaatactgaataatatcattgaatatataatattgaatattattatttcggccaggtgtggtggctcacgtctttaatctcagcactttgggaggctgagggaggcagatcacttgagcccaggagtttgagactagcctgggcaacacagggagagcccatctctctctctctctctttttttttaaattcattacataaaaacagattggggcaacggtttgtttatttacttgcttttgacatcatatttgc

SEQ ID NO: 2845 - DNA, 265 bp, Homo sapiens
aagttttctgcctccacaatctttcaaatgccaacacaaataggaaaagcagaaccccttaaagggacagctcaggttttctctggagcaacttgaaattaacagatttgctattccaacagcggaaaatgcccatttcaacgttggtgagtgctgtatgtttaacatacggaagcaaaacgacgagaaagccgtaacacctaaccattttctacttttaagttgtttctatgactttcaagacaacagaactcctgggattttt

SEQ ID NO: 2846 - DNA, 220 bp, Homo sapiens
gggcatctgatacaggacgttctaacccacagggcactcgcacatgggtaggatgtgacttctatgtactgctctgctctcacagaggccactcaacagtgtaacaccaaagtacatacatggcattcaaaaaggaaaagcaaattatgctttccaagcggcagtgtgttttaccttatcaaaatcatctgagcagtcaagatgaccaagcagtccattt

SEQ ID NO: 2847 - DNA, 233 bp, Homo sapiens
tgtaaccattctcagctgttacatttctgctctttatcctttttttttttttttttggtttaaaagcagcgatccatcagcaacaccaaacttgaaattgatttatgtggaaaaacttggcttgtctgccatctaacaagccctgttgagtaaaataagcaagcttaaatttgattagttgtgtgtctgcctgaaaccatttagtagagcactttaattctgcatggttttta

SEQ ID NO: 2848 - DNA, 230 bp, Homo sapiens
acatgcacacataggattttacttgaaaaaaataataaaggagacagatatgtcaaatctttttcaggcactaataacatgtaaatgtaaaagaactagaatcttctccacataccacctcccatcagaaatcatgtccttgaaagtgctgttgataaagaaatagggttgcctttcccctattccttaatctaattattccagaaacagctgtcattttggttttcatt

SEQ ID NO: 2849 - DNA, 287 bp, Homo sapiens
ttgaacactcagtgctgaccagagattaacatagggcatgcaatactaaaattggtttgcatttcactttctgcttcaacgttcagtaaatccatcatagccctaccaagtgccagggcagttgctggtcagtggttgtcctagtctttctccacaaacctgaaaaaccctggagatttccaaaccccttcaggagcagataacatgaggagacaagacctcagggattcagtctagttggaagatagttgtggcttcttctcagagcctattctggaggtccaaat

SEQ ID NO: 2850 - DNA, 141 bp, Homo sapiens
tttttattacacaaaggttgtcacataattggatacttctctactttgtacacaattattctcactctccacagaaaggctgcttaacttctcatctggtggtggcaagcactaaaatcctgattttaacagaatagtagt

SEQ ID NO: 2851 - DNA, 240 bp, Homo sapiens
aatgttttacacacatgccagcctgcccttcaactggctttcaattttcagtatcttctaatcatggaaatgctaacacaattattaactttaaacaaatttttattacacaaaggttgtcacataattggatacttctctactttgtacacaattattctcactctccacagaaaggctgcttaacttctcatctggtggtggcaagcactaaaatcctgattttaacagaatagtagt

SEQ ID NO: 2852 - DNA, 98 bp, Homo sapiens
gacctaaaactgtctccaggacacaaggctattccaagcaacattaagagagagctctgtaggaaaagagggtcttgtcaacacaattctcagaataa

SEQ ID NO: 2853 - DNA, 177 bp, Homo sapiens
ggactcacaagtcataccctactaaacacccatcagatggacttgtctactttattgagaaacaacagaagatagacctgcaagtccagctgttcatctacctccaccccacagcccaagccacattcccaccctttgtggatgaagctcagggatgcagatcccattccaagatcc

SEQ ID NO: 2854 - DNA, 252 bp, Homo sapiens
gataaatctcacacacatacttccactcatacccaccacatgtattatattagcaatatcatactctaggtcttctggtttgagtcagtataacatgataggcacatttctatggaatttcatgcattattttcttttaatgcttatgagggtaagtaccaaaatatccatttttcattcacagagtagaattattttttgactttttttgtgatcttttgaccaactctcacatccagaaaatgtgccatt

SEQ ID NO: 2855 - DNA, 93 bp, Homo sapiens
  misc_feature (68)..(68): n is a, c, g, or t
caacagaaagatggactaaatataaaggggggaattcctggacctcctttgggtggctagactggtangtcataggctaagccggaagggtgg

SEQ ID NO: 2856 - DNA, 124 bp, Homo sapiens
aaacaagtacaatatcctggcataaaactatctttcagacaaaatccacctgctgtgtattaaaaaatgtaatacttgaaaacttcctgccttgggagagactaaacccgattcataatacaaa

SEQ ID NO: 2857 - DNA, 221 bp, Homo sapiens
gcaggcccggatcttgttctgagcttcgatgtgtgtgaggctacccgcattctcgccatcgatgctcagcacccagtcacccacggacactccggcctgcgccgctttgcccccaggagtgagccgggaaatggagaggggcacattgaagtccttgcccccttgcagccggaagccccaaggtgctggcccctccagcactactttgaaggaatccatga

SEQ ID NO: 2858 - DNA, 40 bp, Homo sapiens
gagcctttgttgctaatcaaatccgggacttgtttgtacg

SEQ ID NO: 2859 - DNA, 153 bp, Homo sapiens
aataaacccaagatcatctgagatgaatattaattttattctcattttatagatgaggaaatgggagttttaaagacattcaataactttggccaaggtcattcagctattaaattttaagaccataaaccaattggattcctggaggaattc

SEQ ID NO: 2860 - DNA, 224 bp, Homo sapiens
gtgcctactatttaaataccctatacctgagttacaaatcacctaagcacaattacaaataattcagcctagcacccatgcaggacactggctagtacatgggtagccagcagagcctcttagcagaggcaaaatcaattgcatttcaaggaaataagtctcccagcatcagaatgcagagatggattctttcctcccctcacttggtccctaattgttctctt

SEQ ID NO: 2861 - DNA, 35 bp, Homo sapiens
gttgcagtgagcctcgatcctgtcactgcactcca

SEQ ID NO: 2862 - DNA, 120 bp, Homo sapiens
gtaagtttaaagcacctgattgggagtgttttgcgtgttcggaatcacttgtaatgttggctgagacaatccttccttgcactttgaaacactttgagcctttaagagatagcctgagaa

SEQ ID NO: 2863 - DNA, 227 bp, Homo sapiens
aaatgcatcaagatataggtgtccttgcattaccaacaatccatagtaaaacaatcattttacaaagccgcataccaaaagtagactaaagtttgagctgtcacagatggtaggtcatttccaaacttggcctggtgggaggaaaaatggcctgcagatagccaggtgacagactgttacctgaggtttgttatataaatgtgggacttaataaactgctatgagct

SEQ ID NO: 2864 - DNA, 206 bp, Homo sapiens
  misc_feature (161)..(161): n is a, c, g, or t
tgctgggctgttctctaccgaataccataaaactgaatattgttcaccactatggtcgatctttctaactttaaagagtacacaactgaactcaattactccaaagatatgtgaaaacacagaaaaatgacccctgttaaaagagtaaacctagcttttgntttactttccttttatataaaaaaagatgtacagggttctcttct

SEQ ID NO: 2865 - DNA, 205 bp, Homo sapiens
gaacatttgggttttcaatcagaaggtttgtgacagcaaagtcattggaataaatctttcttcttgatggagatgaaatatgtggctagtcttcgtgaggcagtcaccaattaatcaacttcagaaaaatagaaccaagcagaatactgaggaggggtgcgttacaggaaataaaaatgctatcagagggcaacccgctctggtc

SEQ ID NO: 2866 - DNA, 223 bp, Homo sapiens
tagacagtccctgttgatgaacatttgggttttcaatcagaaggtttgtgacagcaaagtcattggaataaatctttcttcttgatggagatgaaatatgtggctagtcttcgtgaggcagtcaccaattaatcaacttcagaaaaatagaaccaagcagaatactgaggaggggtgcgttacaggaaataaaaatgctatcagagggcaacccgctctggtc

SEQ ID NO: 2867 - DNA, 222 bp, Homo sapiens
gcccttgggacctcacttgtgggaaccttaacccatcgagacagaaatccggtgacggcgccaagaagctggaccaggggcttcggcgtcgaccacacctgttagagccggaccatggcccgagccgcggcggggccccggaggccacaggccaaggcgggcgaggcagcgctcgaaaacacggtgaccccaagagggagaagccactagcgcagaagggaa

SEQ ID NO: 2868 - DNA, 133 bp, Homo sapiens
  misc_feature (29)..(29): n is a, c, g, or t
  misc_feature (33)..(33): n is a, c, g, or t
ctggacaactttttaatgctgttttaccncagngagaaagcaatgaacaaaagcatattaacatattatcatttaattaaaatgtattcaaaccaactttcaacttgtactaccagtatgtcttaattttata

SEQ ID NO: 2869 - DNA, 95 bp, Homo sapiens
gaggtatcagggaaccgagatcgcaccgctgtactccagcctgggcgacagaacaagacttcgtctcaaaaatatatctatacaagcacaaggtt

SEQ ID NO: 2870 - DNA, 201 bp, Homo sapiens
gaataaggcctctgctagagtcccaaataaaggattaattatcctaaagaaaaagccccaaaataataatctttgggatcaaaaggattctaccatcagcctcatataagtggaacacaatgtaggaagctcttttctcaacctgctttcactactcccagattcaagtaaagccacaaccaatttacaaggcccagtaca

SEQ ID NO: 2871 - DNA, 178 bp, Homo sapiens
gtataataattctgtctgccttgtccagcagtaattgccaggactcaatgggttgatacaaatgaagtagcatgtcagaattagctatcatgatcattgttatttcttctctaaattggtgttttccaaaccgtggcatgcagagatgattttagatggttcacaggtagacttttaa

SEQ ID NO: 2872 - DNA, 293 bp, Homo sapiens
aagagatgagggttcactttgttgcccaggctggtcttgaactcctgggctcaagcaaccctcttgcctccatctcccaaagtgctgggattataggcatcggccactgcacccagctacacacactttttcaccaccactccagcaaagttctgaacagaaaattacctttaaagagtttctctgtgtcataaaaatacttggcaaaaggtattaataaaatctgacatacaagggatgtaatgacccttcaaaatcactattcttattgctcggaagcgatcaatacattg

SEQ ID NO: 2873 - DNA, 279 bp, Homo sapiens
gacttatactcatgaggtctacctacagtccattcccatttaggggaagagaaaggagaggaaatggccaagaagtccataagaagtggacagtgctttaactttttcaagttttgctaacatattttatgtaagttattcaatacccccatattaaagagcagcagctattaaacaccaacatttattagctgctggaaagtaataaataacttcagctagtccccttcagtttccataaaattataaaaccaaccatttgacgtgaaaaagcagttt

SEQ ID NO: 2874 - DNA, 266 bp, Homo sapiens
tgacaaagccactccaattttgctggccaaaaggaaaagtgtcccgggcacaagggctgagttaatggagagcaagtggtaattatctgctctattagatccctcttcctccagcccaatttcatgggaggcttggtttataaaacactggctgtctgactaaacctcaacaacagattaaccataaatgcattcctggaatttacgttcttcccgcctcagtgttgtgtaaaattatcagggaacacagacccacagggtcagga

SEQ ID NO: 2875 - DNA, 45 bp, Homo sapiens
aaaccgtggaccccgcctcgctctgggagtactagggccggcccg

SEQ ID NO: 2876 - DNA, 82 bp, Homo sapiens
gtaagtgtcatttgtataactctaaacgcccatgatagtagcttcaaactggaaatagcgaaataaaataactcagtctgca

SEQ ID NO: 2877 - DNA, 237 bp, Homo sapiens
acatactgtgtattattgtagctagagtcattccttctaagccaaaggaggttttataaaaaagaatcaatattgggccaatccctttgtgccctttttctctttttctatgtgcattttattttttgtctactcttcttcaagttgctctaaactgaaattagggaaggagtctcactttccattacaggtttttctttaaacattaaattaagtggataaggattcaaagtcatc

SEQ ID NO: 2878 - DNA, 176 bp, Homo sapiens
cagcttgtgtaacaaccgattcttaccaaatacaaataaatataaaagacaacttaaaaacaaactgtataatcaaaatctttccgtaaaatagcagctttcacaaagtaaaaacaatttagttccacagagttgtatgctctgtaggcatatggccaattttcttccgagtcctt

SEQ ID NO: 2879 - DNA, 234 bp, Homo sapiens
caggttacaaccgaacacaggattttgtaactgggaaagaacagcttgtgtaacaaccgattcttaccaaatacaaataaatataaaagacaacttaaaaacaaactgtataatcaaaatctttccgtaaaatagcagctttcacaaagtaaaaacaatttagttccacagagttgtatgctctgtaggcatatggccaattttcttccgagtccttttgtcttgcactatcaa

SEQ ID NO: 2880 - DNA, 276 bp, Homo sapiens
aaatcggagacagttttacaatcgcttcatgtcaactacaatggcactgaatgaacaggtttcagctttatacagcattttgcaacatcaacatgcctaggttttttttatttttaaagtctgctgcctactcgtatgtaatatgtgtacataaaagcggcacgtggtttttcgtttaagagtaatctaatatacagaattttggcacgtaaagttttgtacacggtcagtccgggtcctaagggcgcagggtagggcatcccactgggagttcaa

SEQ ID NO: 2881 - DNA, 297 bp, Homo sapiens
ttatgggccctttataaagctatgtacatggggaaacaggtcaggacaggcctccttttgtttaaggggcaaagcattgggggcaaaaaaaacaaaccagttggagctgatggggctccagttaaggcaatgaaggctttgccacaccataaagggctcaggggaagggtcctaaaaaaccacccctgagcagcctggggggaacagccttttggccttctgcccagctcctggctgaagctgtgatctgtgtacctgtgactgcagggcttgaaaatggcggagggcttaggcagt

SEQ ID NO: 2882 - DNA, 145 bp, Homo sapiens
agacaggttgttaaacccacatgcaccaaagggcaagggaacaaccaagcgtcaggagaacccggaggacctcccggggattgggggtcaggttcgctgccataagtactgctgaaaagcaaccctgagtcaatcaccttccctg

SEQ ID NO: 2883 - DNA, 183 bp, Homo sapiens
gctttctccttcttatagacctagaagagaaagacaggttgttaaacccacatgcaccaaagggcaagggaacaaccaagcgtcaggagaacccggaggacctcccggggattgggggtcaggttcgctgccataagtactgctgaaaagcaaccctgagtcaatcaccttccctgggattta

SEQ ID NO: 2884 - DNA, 115 bp, Homo sapiens
ggcacctctggagagttaggacccaggcctgctctcagcacaatgagaggaaaactaaccctgaactccctgccaccccccacccctggcccctggaatgtgttagagtgtagat

SEQ ID NO: 2885 - DNA, 147 bp, Homo sapiens
ggcacctctggagagttaggacccaggcctgctctcagcacaatgagaggaaaactaaccctgaactccctgccaccccccacccctggcccctggaatgtgttagagtgtagatttggaaaagaaacctgcgccaggcatggtgcc

SEQ ID NO: 2886 - DNA, 281 bp, Homo sapiens
aggagactcctagagtggtcccaatggaaaccaatgagggcttgggatgcagcaggggcagaaggagagaagatggtagattctccagatatattttcagagttaaaagcagtaagacttgatgatgaattagtcatggaaaagtaagggagagagttaaagatgactcccagacttcctgctagggccttagtatgataccatttactcccatttaccaccgtttaagaaggggctgaggcaggacattccacgcatgtccaaaggtcccgaggtagcaa

SEQ ID NO: 2887 - DNA, 93 bp, Homo sapiens
ctttgaccctgcacaatgacctttgcatcagccaaactcattgccatgacaactctttgtactgtgtccgtgccacagatctgttggtcacat

SEQ ID NO: 2888 - DNA, 32 bp, Homo sapiens
aactcatactgcaattgcaacacatcttagtt

SEQ ID NO: 2889 - DNA, 200 bp, Homo sapiens
gcctactaattttcaatcaccatagaaaatacagtatttaataatgctgctgctgtacttacataaaacatattaaggaatagatgttatatttctgtgtttgaatattgagcttaaacataaaacatgtttgaaatgtgtttgtgtgtgtctctcacacacacacataacatgtacatacctgaaactcatactgcaat

SEQ ID NO: 2890 - DNA, 168 bp, Homo sapiens
  misc_feature (70)..(70): n is a, c, g, or t
  misc_feature (109)..(109): n is a, c, g, or t
  misc_feature (111)..(111): n is a, c, g, or t
  misc_feature (124)..(124): n is a, c, g, or t
  misc_feature (139)..(139): n is a, c, g, or t
ccatggcaatctgtcttgctgctgtgcagtccttccctgggtggctgcaggggcaaacacagggtttgtnggtcctgggtcttataaaaatcaggtacaaattgacacntntatttaaaagganaaattgccaaatganacaaaatgttttccttatgcaaatttcat

SEQ ID NO: 2891 - DNA, 176 bp, Homo sapiens
gggcgcggagtggagattggctctctgaggtggtcaggggccctgtgacagcttgggactttcagcacctggtttggggtcatttatctgctcaactgtcagaccccccacccccaaaccccagccaccaacacaaccatcgtagaagggaacacaacacagagggtcttttttca

SEQ ID NO: 2892 - DNA, 275 bp, Homo sapiens
tcgtcagtgtgatattttccaaggtaagtctgaatcgtgagtggtcagcacacatggtgggctgctatccgataggacaattcaacagacactgctaattagcatactatatatttaaaaatggacttttatggggaaactagtgtcttgttaattgtcatgaaaggttctcgtgggcaaaattaaatggattcaaggctggccagaatagctttcatgactagggggtaagaatccatgaactttccttcagtccctagcgacagtggctgagg

SEQ ID NO: 2893 - DNA, 206 bp, Homo sapiens
  misc_feature (142)..(142): n is a, c, g, or t
aataaaaacctcagctgaaaagctaataactccagaatgcaggttgaaagcaagcttaaaggtcatctaggctggggtcagtagctcacgcctgcaatcccaacaccctgggaggcccaggtgagaggaccgctcgagcccnggaggtaaaggccgcagcgagctatgaccgcgccactgcacaccagcctgtgccacaaagtaga

SEQ ID NO: 2894 - DNA, 206 bp, Homo sapiens; identical to SEQ ID NO: 2893
  misc_feature (142)..(142): n is a, c, g, or t

SEQ ID NO: 2895 - DNA, 234 bp, Homo sapiens
ggtcttattctgtcactcagactggagtacagtggcatgatcatagctcactgtggccttgaactctggggctcaagcaatcctcttggtggttttaaaaatttttgtagagacaggagtcttgctatattccccaggctggtcttgaattcctgcctcaagcaatcttcctgccttggcctccaaaagcatcaggattacagaagtgagctatcatacctgactcaaatatta

SEQ ID NO: 2896 - DNA, 263 bp, Homo sapiens
gccaatggcagatgagaatcaattcaaaactttcccaagcacctggttctgtgctgggttctggagatacagccatggagaccctgcctatggagctcacagcccagggcaggagacacgtggctcaactgatatccacagtgcaggatgagcaatgctgagagggctgtgcggtggcagggtcagggtactgccagctgccactgcacctaccacgttgaagaatcttctttcattgagttttcacgacagcccttactcct

SEQ ID NO: 2897 - DNA, 275 bp, Homo sapiens
gggtaaacaactatctgatgtacatattcaactgtcactgaggaccagtagagagatcagaatccatgaggaggcaaattctgcctgtttttttctgatataattccagggcccacaagagtacaacagtgcttggcatacagtagaacactaaaaaattacttagtctttaagaatgaatagggtttcaatggtttctagaaatataagatgaagaaaatatcttctggaaatacaaatgaaagaatgaagcatatattattctagacagtaaa

SEQ ID NO: 2898 - DNA, 260 bp, Homo sapiens
  misc_feature (117)..(117): n is a, c, g, or t
  misc_feature (149)..(149): n is a, c, g, or t
  misc_feature (173)..(173): n is a, c, g, or t
  misc_feature (226)..(226): n is a, c, g, or t
acagagcagacagaccagtgatgaccatgggcgggacgaagcctcttccctggaccggggtggcagaggaaagcctaagtgaggggtcagactataaacgttaaggaacccgagatnagcacctgcttcaagtgcacccttcctacctnacaaccagggaccagaactgcaanctttggggacagcacttgggagcagctaacagagcactcacctgccccaaganggccgtcgcagccctggtcctggcaagggaagct

SEQ ID NO: 2899 - DNA, 35 bp, Homo sapiens
gagcagatcacctgaattgcgagtcgagaccagct

SEQ ID NO: 2900 - DNA, 128 bp, Homo sapiens
tggcccagcaatccttaagtccagattaccagctgtggggaggcttccagggggccaggagcaggcttggcagttccagccacagacacgtgggtgaggacggaaatatctccaagggggcacagtat

SEQ ID NO: 2901 - DNA, 277 bp, Homo sapiens
  misc_feature (200)..(200): n is a, c, g, or t
ggcccagcaatccttaagtccagattaccagctgtggggaggcttccagggggccaggagcaggcttggcagttccagccacagacacgtgggtgaggacggaaatatctccaagggggcacagtatcagaggagcaggatggaagggcttttctgcctgctacggatccttttaaagaaatggtgtgaagccggccggngctcatgcctgaatcccatcactttggaggccgagcgagcagatcacctgaattgcgagtcgagaccagctgccaac

SEQ ID NO: 2902 - DNA, 294 bp, Homo sapiens
accgcaggtcggacgccatgacgtaacctttcttctccttgtccaccatcaacatggctagaagaatttctttctttgggtcttcttgttttatttgcatgtgcataatggtcagaaaagtggagaaatccagctctccatttccgtctatcccgtgggtctgcaggtgccgctgcacctcccctggcgttgggctggcccccaggcacctcatggccaccatgaggtcgggggctttatcttccccctctgctgctgtcatacaaggagaagcatttcttgtctcattaattt

What is claimed is:

1. A method of treating cancer in a subject in need thereof comprising administering 5-FU to said subject, wherein the subject has been determined to be responsive to 5-FU according to a method comprising:
   (a) contacting a tumor sample from the subject comprising a plurality of nucleic acid molecules with a device comprising:
      (i) single-stranded nucleic acid molecules capable of specifically hybridizing with the nucleotides of biomarkers of resistance to 5-FU, wherein the biomarkers of resistance are NTSE, CNN3, ACTN1, FLNA, ATP2B4, CYR61, LGALS1, RHOC, RAB32, and TMEM158;
      (ii) single-stranded nucleic acid molecules capable of specifically hybridizing with the nucleotides of biomarkers of sensitivity to 5-FU wherein the biomarkers of sensitivity comprise APRT, GSR, TUFM, MRPS2, MTHFD2, WDR59, ANP32B, PMM2, STOML2, and NDUFAB1;
   (b) detecting a level of expression of the biomarkers of resistance and the biomarkers of sensitivity by performing microarray analysis or quantitative reverse transcriptase polymerase chain reaction (qRT-PCR); and
   (c) calculating a difference score for the subject by subtracting the mean expression levels of the plurality of biomarkers of resistance from the mean expression levels of the plurality of biomarkers of sensitivity, wherein the difference score is above a cutoff value.

2. The method of claim 1, further comprising administering one or more additional therapies to said subject, wherein said one or more additional therapies is administered:
   (a) concurrently with said administration of 5-FU; or
   (b) separately from said administration of 5-FU; or
   (c) prior to said administration of 5-FU; or
   (d) after said administration of 5-FU.

3. The method of claim 2, wherein said one or more additional therapies is administered within 1 week of said administration of 5-FU.

4. The method of claim 2, wherein said one or more additional therapies comprises one or more additional therapeutic agents, surgery, or radiation therapy.

5. The method of claim 4, wherein said one or more additional therapies comprises one or more additional therapeutic agents, wherein said 5-FU is administered alone or in admixture with said one or more additional therapeutic agents.

6. The method of claim 5 wherein said one or more additional therapeutic agents is selected from:
   (a) the group consisting of: irinotecan, oxaliplatin, cetuximab, leucovorin, SN-38, everolimus, temsirolimus, bleomycin, lomustine, depsipeptide, carboplatin, bortezomib, erlotinib, gemcitabine, mitoxantrone, cisplatin, busulfan, epirubicin, arsenic trioxide, bendamustine, vincristine, fulvestrant, teniposide, adriamycin, decitabine, and estramustine; or
   (b) everolimus, temsirolimus, bleomycin, or lomustine; or
   (c) leucovorin and at least one of irinotecan or oxaliplatin.

7. The method of claim 1, wherein said 5-FU is administered to said subject intravenously, orally, intraperitoneally, intramuscularly, topically, rectally, cutaneously, subcutaneously, nasally, intracerebroventricularly, intraparenchymally, intrathecally, intracranially, ocularly, via inhalation, or through the skin.

8. The method of claim 7, wherein said 5-FU is administered to said subject:
   (a) once daily; and/or
   (b) once daily, for up to four years; and/or
   (c) once weekly, once every other week, or once every three weeks; and/or (d) in six week cycles; and/or
(c) repeated 30 days after the completion of the previous administration; and/or
(d) repeated for at least 12 to 60 months.

9. The method of claim 1, wherein said 5-FU is administered to the subject once daily at a dose of up to 800 mg.

10. The method of claim 1, further comprising determining the expression level of one or more additional biomarkers, wherein said one or more additional biomarkers is selected from the group consisting of: carcinoembryonic antigen (CEA), BRAF, KRAS, Fas-ligand, p53, Ki-67, thymidylate-synthase, dihydropyrimidine dehydrogenase, thymidine phosphorylase, microsatellite instability (MIS), and 18q allelic loss of heterozygosity (LOH18q).

11. A method of treating cancer in a subject in need thereof comprising administering 5-FU to the subject with a difference score above a cutoff value, wherein the difference score is the difference between a mean of a level of expression of biomarkers of sensitivity and a mean of a level of expression of biomarkers of resistance determined in a tumor sample from the subject, wherein the biomarkers of sensitivity are APRT, GSR, TUFM, MRPS2, MTHFD2, WDR59, ANP32B, PMM2, STOML2, and NDUFAB1 and the biomarkers of resistance are NT5E, CNN3, ACTN1, FLNA, ATP2B4, CYR61, LGALS1, RHOC, RAB32, and TMEM158.

12. The method of claim 11, wherein the cutoff value is a 50th percentile of the difference score in a reference population with the same diagnosis as the subject, or greater.

13. The method of claim 12, wherein the cutoff value is a 60th percentile of the difference score in a reference population with the same diagnosis as the subject, or greater.

14. The method of claim 13, wherein the cutoff value is a 70th percentile of the difference score in a reference population with the same diagnosis as the subject, or greater.

15. The method of claim 14, wherein the cutoff value is an 80th percentile of the difference score in a reference population with the same diagnosis as the subject, or greater.

* * * * *

UNITED STATES PATENT AND TRADEMARK OFFICE
CERTIFICATE OF CORRECTION

| | | |
|---|---|---|
| PATENT NO. | : 10,570,457 B2 | Page 1 of 1 |
| APPLICATION NO. | : 15/509798 | |
| DATED | : February 25, 2020 | |
| INVENTOR(S) | : Steen Knudsen | |

It is certified that error appears in the above-identified patent and that said Letters Patent is hereby corrected as shown below:

In the Claims

Column 493, Line 44, Claim 1 replace "NTSE" with --NT5E--.

Column 495, Line 2, Claim 8 replace "(c) repeated" with --(e) repeated--.
      Line 4, Claim 8 replace "(d) repeated" with --(f) repeated--.

Signed and Sealed this
Twenty-seventh Day of July, 2021

Drew Hirshfeld
*Performing the Functions and Duties of the*
*Under Secretary of Commerce for Intellectual Property and*
*Director of the United States Patent and Trademark Office*